US011259473B2

(12) United States Patent
Liu et al.

(10) Patent No.: US 11,259,473 B2
(45) Date of Patent: Mar. 1, 2022

(54) TMV RESISTANT TOBACCO PLANT CONTAINING SHORT N INTRODUCED FRAGMENT AND METHOD FOR BREEDING SAME

(71) Applicant: Yunnan Academy of Tobacco Agricultural Sciences, Yunnan (CN)

(72) Inventors: Yong Liu, Yunnan (CN); Changjun Huang, Yunnan (CN); Yongping Li, Yunnan (CN); Haiqin Yu, Yunnan (CN)

(73) Assignee: YUNNAN ACADEMY OF TOBACCO AGRICULTURAL SCIENCES, Yunnan (CN)

(*) Notice: Subject to any disclaimer, the term of this patent is extended or adjusted under 35 U.S.C. 154(b) by 0 days.

(21) Appl. No.: 16/648,284

(22) PCT Filed: Sep. 20, 2017

(86) PCT No.: PCT/CN2017/102444
§ 371 (c)(1),
(2) Date: Mar. 18, 2020

(87) PCT Pub. No.: WO2019/056206
PCT Pub. Date: Mar. 28, 2019

(65) Prior Publication Data
US 2021/0120752 A1    Apr. 29, 2021

(51) Int. Cl.
*A01H 5/12*    (2018.01)
*A01H 1/04*    (2006.01)
*A01H 1/00*    (2006.01)
*A01H 6/82*    (2018.01)

(52) U.S. Cl.
CPC ............ *A01H 1/126* (2021.01); *A01H 1/045* (2021.01); *A01H 5/12* (2013.01); *A01H 6/823* (2018.05)

(58) Field of Classification Search
CPC ........ A01H 1/126; A01H 6/823; A01H 1/045; A01H 5/12
See application file for complete search history.

(56) References Cited

U.S. PATENT DOCUMENTS

| 4,520,020 A | 5/1985 | Loebenstein et al. |
| 6,372,962 B1 | 4/2002 | Baker et al. |

FOREIGN PATENT DOCUMENTS

| CN | 1157549 A | 8/1997 |
| CN | 101892304 A | 11/2010 |
| CN | 103866038 B | 9/2015 |
| CN | 105200052 A | 12/2015 |
| CN | 105200149 A | 12/2015 |
| CN | 105274120 B | 7/2018 |
| CN | 104830982 B | 8/2018 |

OTHER PUBLICATIONS

Bagley, C. A. (2001). Controlling tobacco mosaic virus in tobacco through resistance (Doctoral dissertation, Virginia Tech (Year: 2001).*
Lewis, R. S., S. R. Milla, and J. S. Levin. "Molecular and genetic characterization of *Nicotiana glutinosa* L. chromosome segments in tobacco mosaic virus-resistant tobacco accessions." Crop science 45.6 (2005): 2355-2362. (Year: 2005).*
Leitch, I. J., et al. "The ups and downs of genome size evolution in polyploid species of *Nicotiana (Solanaceae)*." Annals of botany 101.6 (2008): 805-814. (Year: 2008).*
Sierro, Nicolas, et al. "The tobacco genome sequence and its comparison with those of tomato and potato." Nature communications 5.1 (2014): 1-9. (Year: 2014).*
Lewis, Ramsey S., and Cara Rose. "Agronomic Performance of Tobacco Mosaic Virus-Resistant Tobacco Lines and Hybrids Possessing the Resistance Gene N Introgressed on Different Chromosomes." Crop science 50.4 (2010): 1339-1347. (Year: 2010).*
International Search Report/Written Opinion in related/corresponding PCT Application No. PCT/CN2017/102444 dated Jun. 8, 2018.
R.S. Lewis et al., "Molecular and Genetic Characterization of *Nicotiana glutinosa* L. Chromosome Segments in Tobacco Mosaic Virus-Resistant Tobacco Accessions," Crop Science, Nov. 2005, pp. 2355-2362, vol. 45.
Yong Liu et al., "N Introgression Segment Length Polymorphism of Newly Tested *Nicotiana Tabacum* Germplasm Highly Resistant to Tobacco Mosaic Virus," Sep. 6, 2017, pp. 95-98, vol. 23, No. 6, including English abstract.

* cited by examiner

*Primary Examiner* — Weihua Fan
(74) *Attorney, Agent, or Firm* — Patent Portfolio Builders PLLC

(57) ABSTRACT

A TMV resistant tobacco plant containing a short N introgressed segment and a method for breeding the same. A homozygous tobacco plant containing an N introgressed segment is hybridized with a tobacco plant of genotype nn to obtain an F1 progeny tobacco plant of genotype Nn. The F1 progeny tobacco plant is hybridized with the tobacco plant of genotype nn, to obtain population materials for screening to obtain the short N introgressed segment. TMV is inoculated at a seedling stage, and Nn genotype plants showing necrotic lesion are obtained by screening the population materials. The Nn genotype plants are genotyped using a molecular marker TN5.51 primer pair and an N gene-specific molecular marker N1N2 at the right end of the N introgressed segment. A plant found to be negative when tested by the TN5.51 primer pair and to be positive when tested by the N1N2 molecular marker is a plant comprising the short N introgressed segment. The size of non-target genomic components deleted from plants containing the short N introgressed segment is estimated using TN5.34 and TN5.20 and TN4.99 primer pairs. The obtained short N introgressed segment is applicable to germplasma innovation and breeding of TMV resistant tobacco. The invention is helps to reduce linkage drag with the N gene.

8 Claims, 1 Drawing Sheet
Specification includes a Sequence Listing.

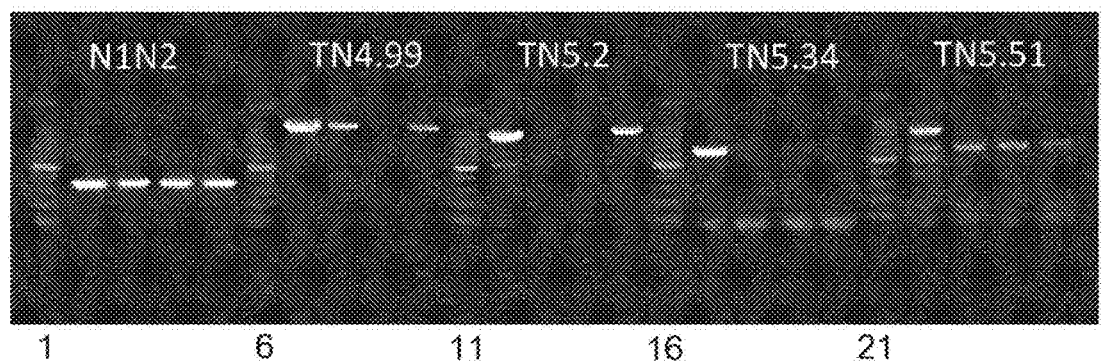

TMV RESISTANT TOBACCO PLANT CONTAINING SHORT N INTRODUCED FRAGMENT AND METHOD FOR BREEDING SAME

FIELD OF THE INVENTION

The invention relates to the field of tobacco breeding, particularly to a TMV-resistant tobacco plant comprising a short N introgressed segment and a method for breeding the same.

BACKGROUND OF THE INVENTION

Tobacco mosaic virus (TMV) is a major disease on tobacco (*Nicotiana tabacum* L.). Plantation of a TMV-resistant variety is still the most fundamental and most cost-effective means of preventing and controlling TMV. A resistant variety to be promoted need to be a variety with high resistance, and without negative influence in terms of yield and agronomic traits.

Currently, TMV resistance for cultivar tobacco is mainly derived from a wild tobacco species of *Nicotiana glutionsa*, and the resistance thereof is controlled by one dominant single gene (N). The N gene was cloned in 1994 and is the first NBSs resistant gene cloned in plants. N gene is resistant to TMV-U1 line. The genomic sequence size of the N gene is 6656 bp, including 5 exons and 4 introns, belonging to resistant gene of TIR-NBS-LRR type. The resistant mechanism of N gene is to trigger hypersensitive necrotic spots (lesions) at the site of virus infection, and the movement of TMV in the plant is restricted by inducing hypersensitive cell death. After mediating the hypersensitivity reaction, tobacco plants can acquire systemic resistance, which produces a broad-spectrum resistance to re-invasion of TMV or other similar pathogens. Through a series of conventional hybridization and backcrossing, the resistance of N gene is transferred from *Nicotiana glutionsa* to an oriental tobacco and then to a tobacco variety. Transferring the resistance of N gene by hybridization is actually transferring a chromosome segment of *Nicotiana glutionsa* comprising N gene (abbreviated as N introgressed segment). N introgressed segment is used for almost all TMV-resistant tobacco breeding in the world. A representative variety is TMV resistant tobacco varieties comprising N introgressed segment planted commercially earlier, i.e. Coker176 and Speight H20. Due to linkage drags involving such as low yield and slow yellowing of the upper leaves, the tobacco varieties comprising an N introgressed segment as long as that of Coker176 could not meet the urgent needs of production. It has been proved that N gene itself do not involve any linkage drag of yield and output, and such a linkage drag is derived from the non-target genomic component (abbreviated as drag genomic component) linked to N gene on the N introgressed segment as long as that of Coker176. It is expected to reduce the linkage drag of the N introgressed segment by reducing the non-target genomic component linked to N gene on the N introgressed segment as long as N introgressed segment of Coker176. However, the N introgressed segment has low homology with the common tobacco chromosome, and thus it is possible but quiet low frequency for chromosome crossover between the N introgressed segment and the common tobacco (with a probability of about 1/2000). Even if any chromosome crossover occurs, a chromosome-crossovered plant with a short N introgressed segment (Ns segment) cannot be screened out from the breeding population by conventional breeding techniques. Because the drag phenotype as a quantitative trait is susceptible to environmental conditions and is difficult to be screened out in the early stage of breeding. In addition, the lack of technical means for detecting non-target genomic components linked to IV gene on the N introgressed segment hinders the breakthrough in TMV-resistant tobacco breeding. Therefore, how to overcome the negative influence of the prior art is an urgent problem to be solved in the field of TMV-resistant tobacco breeding.

SUMMARY OF THE INVENTION

The present invention is directed to address the negative influence of the prior art and to provide a TMV-resistant tobacco plant comprising a short N introgressed segment and a method for breeding the same. The drag genomic component linked to N gene is deleted from the TMV-resistant tobacco plant comprising the short N introgressed segment. The linkage drag of the N introgressed segment can be therefore reduced. It can be used for breeding a tobacco variety with high TMV resistance and without obvious negative influence in terms of yield and quality. In the context of the present invention, the term "N introgressed segment" refers to a chromosome segment of a wild species tobacco comprising a TMV-resistant gene (N gene).

The term "short N introgressed segment" refers to a DNA segment in which the non-target genomic component (abbreviated as drag genomic component) linked to N gene on the N introgressed segment is partially or completely deleted, and the intact function of the N gene is retained.

The term "drag genomic component" refers to a genomic component comprising a drag gene but not N gene on the N introgressed segment.

The present invention is further directed to provide a method of obtaining a TMV-resistant tobacco plant comprising a short N introgressed segment.

The present invention is further directed to use of a TMV-resistant tobacco plant comprising a short N introgressed segment in breeding a TMV-resistant tobacco variety.

The present invention provides a TMV-resistant tobacco plant comprising a short N introgressed segment, wherein the drag genomic component is reduced by at least 0.51 Mb, preferably at least 0.93 Mb, more preferably at least 1.56 Mb in the short N introgressed segment, compared to that in an N introgressed segment of Coker176 type tobacco accessions.

In one preferred embodiment of the invention, partial or entire sequence of SEQ ID No. 13 is at least deleted in the short N introgressed segment, compared to N introgressed segment of Coker176 type tobacco accessions.

In another preferred embodiment of the present invention, at least a sequence corresponding to bases at positions of 806,912 to 1,404,293 in the sequence of SEQ ID No. 13 is deleted in the short N introgressed segment, as compared to the N introgressed segment of Coker176 type tobacco accessions.

In another preferred embodiment of the present invention, the TMV-resistant tobacco plant is selected from the group consisting of:

a) a tobacco plant that is detected as positive for the N1N2 marker and negative for both of the TN5.34 primer pair and the TN5.51 primer pair;

b) a tobacco plant that is detected as positive for the N1N2 marker and negative for the TN5.20 primer pair, the TN5.34 primer pair and the TN5.51 primer pair; and c) a tobacco plant that is detected as positive for the N1N2 marker and negative for the TN4.99 primer pair, the TN5.20 primer pair, the TN5.34 primer pair and the TN5.51 primer pair.

In another preferred embodiment of the invention, the short N introgressed segment is obtained by means of chromosome crossover, genome editing, chemical mutagenesis or physical mutagenesis.

In still another preferred embodiment of the present invention, the TMV-resistant tobacco plant is derived from Nicotiana genus, preferably from flue-cured tobacco, burley tobacco, oriental tobacco, sun-cured tobacco or cigar tobacco.

The present invention provides a tobacco hybrid, a variety or a line bred with the TMV-resistant tobacco plant comprising a short N introgressed segment.

The present invention provides a seed, a pollen and an ovule of the TMV-resistant tobacco comprising a short N introgressed segment.

The invention also provides use of a TMV-resistant tobacco plant comprising a short N introgressed segment in breeding a TMV-resistant tobacco variety.

The present invention also provides a method of breeding a TMV-resistant tobacco plant comprising a short N introgressed segment comprising a) hybridizing a tobacco plant having a homozygous N introgressed segment with a tobacco plant having nn genotype to obtain a F1 tobacco plant having Nn genotype, and then hybridizing the F1 tobacco plant with the tobacco plant having nn genotype to obtain a population material for screening the short N introgressed segment;

b) inoculating TMV to the population material obtained in step a) during the seedling stage, and screening a Nn genotype plant exhibiting lesions in the population material; and c) genotyping the Nn genotype plant screened in step b) with a molecular marker of TN5.51 primer pair at the right end of the N introgression segment and N gene-specific molecular marker N1N2, and screening a plant detected as positive for the molecular marker N1N2 and negative for the TN5.51 primer pair.

The present invention also provides a method of breeding a TMV-resistant tobacco plant comprising a short N introgressed segment comprising a) hybridizing a tobacco plant having homozygous N introgressed segment with a tobacco plant having nn genotype to obtain a F1 tobacco plant having Nn genotype, and then hybridizing the F1 tobacco plant with a tobacco plant having nn genotype to obtain a population material for screening the short N introgressed segment;

b) inoculating TMV to the population material obtained in step a) during the seedling stage, and screening a plant with Nn genotype exhibiting lesions in the population material; and c) genotyping the Nn genotype plant screened in step b) with TN5.34 primer pair, TN5.51 primer pair and N gene-specific molecular marker N1N2, and screening a plant detected as positive for the molecular marker N1N2 and negative for the TN5.34 primer pair and the TN5.51 primer pair.

The present invention also provides a method of breeding a TMV-resistant tobacco plant comprising a short N introgressed segment comprising a) hybridizing a tobacco plant having homozygous N introgressed segment with a tobacco plant having nn genotype to obtain a F1 tobacco plant having Nn genotype, and then hybridizing the F1 tobacco plant with a tobacco plant having nn genotype to obtain a population material for screening the short N introgressed segment;

b) inoculating TMV to the population material obtained in step a) during the seedling stage, and screening a plant with Nn genotype exhibiting lesions in the population material; and c) genotyping the Nn genotype plant screened in step b) by using TN5.20 primer pair, TN5.34 primer pair, TN5.51 primer pair and N gene-specific molecular marker N1N2, and screening for a plant detected as positive for the molecular marker N1N2 and negative for the TN5.20 primer pair, the TN5.34 primer pair and the TN5.51 primer pair.

The present invention also provides a method of breeding a TMV-resistant tobacco plant comprising a short N introgressed segment comprising a) hybridizing a tobacco plant having homozygous N introgressed segment with a tobacco plant having nn genotype to obtain a F1 tobacco plant having Nn genotype, and then hybridizing the F1 tobacco plant with a tobacco plant having nn genotype to obtain a population material for screening the short N introgressed segment;

b) inoculating TMV to the population material obtained in step a) during the seedling stage, and screening for a plant with Nn genotype exhibiting lesions in the population material; and c) genotyping the Ain genotype plant screened in step b) by using TN4.99 primer pair, TN5.20 primer pair, TN5.34 primer pair, TN5.51 primer pair and N gene-specific molecular marker N1N2, and screening for a plant detected as positive for the molecular marker N1N2 and negative for the TN4.99 primer pair, the TN5.20 primer pair, TN5.34 primer pair and the TN5.51 primer pair.

The present invention provides use of a short N introgressed segment in a. TMV-resistant tobacco plant, wherein the drag genomic component is reduced by at least 0.51 Mb, preferably at least 0.93 Mb, more preferably at least 1.56 Mb in the short N introgressed segment, compared to that in N introgressed segment of Coker176 type tobacco accessions.

In a preferred embodiment of the invention, at least partial or entire of the sequence of SEQ ID No. 13 is deleted in the short N introgressed segment, compared to N introgressed segment of Coker176 type tobacco accessions.

In a preferred embodiment of the invention, the use results in a tobacco plant selected from the group consisting of:

a) a tobacco plant that is detected as positive for the marker N1N2 and negative for both of the TN5.34 primer pair and the TN5.51 primer pair;

b) a tobacco plant that is detected as positive for the marker N1N2 and negative for the TN5.20 primer pair, the TN5.34 primer pair and the TN5.51 primer pair; and c) a tobacco plant that is detected as positive for the marker N1N2 and negative for the TN4.99 primer pair, the TN5.20 primer pair, the TN5.34 primer pair and the TN5.51 primer pair.

In a preferred embodiment of the invention, the short N introgressed segment is obtained by means of chromosome crossover, genome editing, chemical mutagenesis or physical mutagenesis.

In a preferred embodiment of the present invention, the tobacco plant is derived from Nicotiana genus, preferably from flue-cured tobacco, burley tobacco, oriental tobacco, sun-cured tobacco or cigar tobacco.

The present invention also provides a tobacco hybrid, a variety or a line bred from the tobacco plant obtained according to the use described above.

The present invention also provides a seed, a pollen and an ovule of the tobacco plant obtained according to the use described above.

In the context of the present invention, a tobacco having homozygous N introgressed segment refers to a tobacco comprising an N introgressed segment, preferably a common tobacco comprising an N introgressed segment as long as that of Coker176 variety, including, but not limited to flue-cured tobacco, burley tobacco, sun-cured tobacco, oriental tobacco, cigar tobacco, and other tobacco varieties. The N introgressed segment as long as that of Coker176 type is characterized in that it is detected as negative for the GL4.06 primer pair and positive for the TN5.51 primer pair. A common tobacco comprising an N introgressed segment as long as that of Coker176 type includes, but is not limited to 6349, 7402, 7915, 8100, 8211, 8212, 78-3013, 8902-42, B09, Burley21, B22, B49, B64, Banket-A-1, BG4, BYS, CV85, V87, Coker 86, Coker 51, Coker176, EMH14, Ergo, ETWM10, GH12, K10, K14, Ky10, Ky12, Ky 41A, Ky14, Ky15, Ky17, Ky171, Ky56, Ky8959, Ky8959 (BC4), Ky9, Ky907 (BC4), Ky908, MS ky17, MBN2, MS Burley21 X Ky14, MRS-3, MS B21, MS Ky10, MSKy14XL8, NC3, NC567, NC7, NC86, PVH01, PVH02, PVH05, PVH06, PVH07, PVH08, RGH04, SC71, SC72, TN97, Vamoor 48, Virginia 1, Virginia 3160, Virginia 645, Virginia 770, Virginia 80, Va 1048, WE-12, WB68, RT32, Bayin No. 1, Dabaijin 2518, Liaoyan No. 9, Liaoyan No. 14, Mudan 80-7, Mudan 81-56, Taiyan No. 5, Taiyan No. 6, Wutongyan 1012, Zhongwei No. 1, Yinba 1, Yunyan 202402, 521, 911, 8358, Blue star 100, Burley mammoth ky16, Burley21, 06160, CCC-h, CCC-L, Coker 51, Ex 12, Gen 164, Gen 224, Gr 38a, Havana 425, Havana 426, Havana 503b, Havanan 503, Holmes breeding line-1, KHD926, KY165, KY21, KY22, KY35, KY8654, lancaster seed, M-1, Massck-1, MD A30, MD B100, MD40, MD402, Metacomet, MRS-1, MRS-3, NC102, NC297, NC-BMR 90, NIC 112, NIC 112B (PL10), NIC 112b (PL11), NIC 112C-G (PL271), NIC 112C-G (PL37), NIC 117D-1B, OS 802, Poquonock, Southern beauty, Vamorr48, and WB68.

A tobacco with nn genotype refers to a tobacco without N gene, preferably; a common tobacco without N gene, including but not limited to flue-cured tobacco, burley tobacco, sun-cured tobacco, oriental tobacco and cigar tobacco and other common tobacco varieties. The phenotypic trait of tobacco with nn genotype includes disease resistance, high yield, high grade index, easily cured, leaf quality; plant height, a mature characteristic of early to late maturity, and a moderate to large number of plant leaves. The tobacco having nn genotype preferably includes, but is not limited to, K326, Yunyan 87, Yunyan, 97, Yunyan, 85, NC89, Zhongyan 100, Honghuadajinyuan, and Cuibi No. 1.

The tobacco hybrid, variety or line consists of a plant comprising short N introgressed segment. The plant comprising the short N introgressed segment was TMV-resistant and reduced in the non-target genomic component linked to N gene, compared with the plant comprising the N introgressed segment. At least partial or entire sequence in SEQ ID No. 13 is deleted from the plant comprising the short N introgressed segment. The plant comprising the short N introgressed segment is detected as negative for both of the GL4.06 primer pair and the TN5.51 primer pair. Preferably, the plant is detected as negative for the TN4.99 primer pair or the TN5.30 primer pair or the TN5.34 primer pair.

A method to obtain a plant comprising a short N introgressed segment in which at least partial or entire sequence of SEQ ID No, 13 is deleted, comprises obtaining a Nn population material by means of hybridization breeding, and screening a plant with chromosome crossover. Genome editing method, chemical mutagenesis, physical mutagenesis or biotechnology can also be used. The chemical or physical mutagenesis method is used to screen a mutant in which partial to entire sequence of SEQ ID No. 13 is deleted. The chemical mutagenesis method includes treatment with a mutagenesis agent such as sodium azide, ethidium bromide, and ethyl methanesulfonate. The physical mutagenesis method includes X-rays, gamma rays, fast neutron radiation, heavy ion radiation, and ultraviolet radiation. The genome editing method of biotechnology includes knocking out partial to entire sequence of SEQ ID No. 13 by using CRISPR/Cas9 technology, zinc finger endonuclease (ZFN) technology, and transcription-activator-like effector nuclease (TALEN) technology. The partial sequence has an appropriate length that is not particularly limited, for example, 1 bp, 10 bp, 100 bp, 1 Kb, 10 Kb, 100 Kb, or 1000 Kb in length, or 2000 Kb in full length.

Process of screening for TMV-resistant tobacco plant comprising the short N introgressed segment by using hybridization and molecular marker screening techniques comprises hybridizing a tobacco plant comprising homozygous N introgressed segment and negative for the GL4.06 primer pair and positive for the TN5.51 primer pair, with the tobacco plant having nn genotype, to obtain the descendant plant with Nn genotype. The Nn descendant plant was hybridized with the tobacco plant having the nn genotype, to obtain a population material used for screening the short N introgressed segment. TMV is inoculated at a seedling stage, and Nn genotype plant showing lesions are obtained by screening from the population material. The Nn genotype plant is extracted for DNA and genotyped with the molecular marker TN5.51 primer pair at the right end of the N introgressed segment and the N gene-specific molecular marker N1N2. The plant detected as negative for the TN5.51 primer pair and positive for the N1N2 molecular marker is screened out, which is the plant containing the short N introgressed segment.

The Nn descendant is hybridized a tobacco having the nn genotype, to obtain the population material used for screening the short N introgressed segment. The population material includes a breeding population material comprising the Nn genotype. Backcrossing population material of BC1F1, BC2F1, BC3F1, BC4F1, BCSF1 . . . , and BCnF1 materials are preferred, with n representing the number of generations of backcrossing and can be 6, 7, 8, 9, 10, 15, and 20. Other population materials are also included, such as self-crossing population material F2 comprising the Nn genotype.

A method for screening Nn genotype plant from the breeding population material comprising Nn genotype includes artificial inoculation of TMV, and also molecular marker-assisted screening method depending on resistant phenotypes. A preferred method for screening resistant phenotype includes: inoculating TMV during seedling stage, and screening out the plant exhibiting lesions used for screening the plant comprising the short N introgressed segment from the population material. A molecular marker-assisted screening method includes detecting the molecular marker of N gene or a gene closely linked to N gene in the breeding population material, and screening out an N gene-positive plant for screening a plant comprising the short N introgressed segment according to the result of molecular marker detection.

A method of screening a plant comprising the short N introgressed segment includes using an N introgressed segment-specific molecular marker, or a molecular marker closely linked to the N introgressed segment, or a phenotypic marker closely linked to the N introgressed segment; preferably, a molecular marker of the end of the N introgressed segment; and more preferably, a molecular marker amplified by the TN5.51 primer pair.

A method for detecting a molecular marker includes PCR detection, molecular hybridization, and the like, with the preference of PCR detection. A method for detecting PCR amplification product includes electrophoresis detection. The electrophoretic detection includes agarose gel electrophoresis and detection with fragment analyzer. The method for molecular hybridization comprises hybridizing a nucleic acid sample in screened population material with a partial nucleic acid segment of a molecular marker, amplified by a TN5.51 primer pair, as a probe.

The present invention also discloses a method of breeding a TMV-resistant tobacco comprising a short N introgressed segment. The TMV-resistant tobacco comprising the short N introgressed segment was hybridized with a second tobacco plant having nn genotype, and the TMV-resistant tobacco comprising the short N introgressed segment was selected among the hybridized descendants. A TMV-resistant tobacco line or variety comprising the short N introgressed segment is obtained by a conventional breeding method. The phenotype of the second plant includes, but is not limited to disease resistance and high yield. The hybridization method include self-pollination or hybridization between a pollen donor and a pollen receptor (male fertile or male sterile) to obtain a hybrid or a male sterile hybrid. One or both of the pollen receptor or the pollen donor comprise the short N introgressed segment.

The DNA fragment of the nucleotide sequence set forth in SEQ ID NO. 13 disclosed in the present invention is a chromosome segment of *Nicotiana glutionsa* closely linked to N gene. Transferring the resistance of N gene by hybridization is actually transferring a chromosome segment of *Nicotiana glutionsa* comprising N gene. The sequence set forth in SEQ ID NO. 13 is a partial sequence closely linked to N gene on the N introgressed segment, and specifically, is a non-target genomic component linked to N gene. The genomic component comprising the sequence set forth in SEQ ID NO. 13 bring linkage drag in a common tobacco. Knocking out a partial or entire sequence set forth in SEQ ID NO. 13 reduce the linkage drag. It will be understood by those skilled in the art that when a partial or entire sequence set forth in SEQ ID NO. 13 is knocked out, the effect of the present invention can also be achieved by simultaneous knock out of the upstream and downstream sequences of the 5' end and/or the 3' end of SEQ ID NO. 13. The length of the upstream and downstream sequences of the 5' end and/or the 3' end of SEQ ID NO. 13 is appropriate, and is not particularly limited, for example, more than 1 Kb, more than 10 Kb, more than 50 Kb, more than 100 Kb, more than 500 Kb, more than 1000 Kb, more than 2000 Kb or more than 5000 Kb.

The invention further discloses use of the TMV-resistant tobacco plant comprising the short N introgressed segment in breeding a TMV-resistant tobacco variety as above.

The present invention provides a TMV-resistant tobacco plant comprising a short N introgressed segment. The molecular marker of the present invention is used to reduce the non-target genomic component linked to N gene on the N introgressed segment, rather than to evaluate whether there is any resistance mediated by N gene, compared to N gene resistance-related molecular marker that has been reported. Conventional breeding techniques fail to screen out a chromosome crossover plant comprising short N introgressed segment from the breeding population. In the invention, a breeding population is prepared and screened with N right-end molecular marker TN5.51, N gene-specific molecular marker and SEQ ID NO. 13 molecular marker, to obtain the chromosome crossover plant comprising the short N introgressed segment from a large breeding population material, and to preliminarily identify the number of the reduced non-target genomic components. The TMV-resistant plant comprising the short N introgressed segment obtained in the invention is used for creating a novel TMV-resistant germplasm resource, and breeding the TMV-resistant tobacco variety, which are beneficial to reduce the drag linked to N gene.

DESCRIPTION OF THE FIGURES

FIG. 1 is result of electrophoretic detection for a product of a plant comprising a short N introgressed segment amplified with N1N2, TN4.99, TN5.20, TN5.34, and TN5.51 primer pairs;

In FIG. 1, from left to right, 1st, 6th, 11th, 16th, and 21th lanes are 100 bp DNA Ladder; 2nd to 5th lanes are Coker176, 15-7F, 24-8H, 99-2D, respectively; amplified with the primer pair N1N2; 7th to 10th lanes are Coker176, 15-7F, 24-8H, 99-2D amplified with TN4.99; 12th to 15th lanes are Coker176, 15-7F, 24-8H, 99-2D amplified with the primer pair TN5.20; 17th to 20th lanes are respectively Coker176, 15-7F, 24-8H, 99-2D amplified with the primer pair TN5.34; 22th to 25th lanes are respectively Coker176, 15-7F, 24-8H, 99-2D amplified with the primer pair TN5.51.

DETAILED DESCRIPTION OF THE INVENTION

To illustrate the purposes, technical solutions and advantages of the present invention, the present invention will be further described in detail with reference to the figures and examples. Where specific techniques or conditions are not indicated in the examples, they are carried out according to the techniques or conditions described in the art or in accordance with the product specifications. Where the reagents or instruments used are not specified by the manufacturer, they are conventional products that can be commercially available. Obviously; the described examples are only a part of the examples of the present invention, rather than all of the examples. All other examples obtained by those skilled in the art based on the examples of the present invention without creative work shall be within the scope of the present invention.

A TMV-resistant tobacco plant Coker176 comprising an N introgressed segment and a TMV-susceptible material Yunyan 87 excludes an N introgressed segment are used. The above tobacco plants are common tobacco germplasm resources, which can be obtained by the public from a tobacco germplasm resources depositary authority or the Yunnan Academy of Tobacco Agricultural Sciences.

The DNA extraction kit was purchased from QIAGEN. DNA Marker and Taq DNA polymerase were purchased from Takara Biomedical Technology (Dalian) Co., Ltd. Other chemical reagents are commercially available products. The primers used in the present invention are listed in Table 1.

TABLE 1

Primer sequences

| | | |
|---|---|---|
| GL4.06 | Forward primer | 5'-GATCCCACGAGTGGAGCA-3' (SEQ ID NO. 1) |
| | Reverse primer | 5'-TCCTCACCAAACCCAACTTT-3' (SEQ ID NO. 2) |
| TN5.20 | Forward primer | 5'-CGACTTTCAAAGGGAATCCA-3' (SEQ ID NO. 3) |
| | Reverse primer | 5'-TGCCTGCCAAGTGACTACAG-3' (SEQ ID NO. 4) |
| TN4.99 | Forward primer | 5'-TGCCACACAGGGTGACTAGA-3' (SEQ ID NO. 5) |
| | Reverse primer | 5'-AAGCAAAACTGTGTCATTAGGC-3' (SEQ ID NO. 6) |
| TN5.51 | Forward primer | 5'-TTCGGGTTTTTAGTTCGGTTT-3' (SEQ ID NO. 7) |
| | Reverse primer | 5'-AGGCACCATGTCACAAACA-3' (SEQ ID NO. 8) |
| TN5.34 | Forward primer | 5'-CACTTTGGCCTGTCACACAA-3' (SEQ ID NO. 9) |
| | Reverse primer | 5'-AAACTTGTTCATAGTCTGCGAAT-3' (SEQ ID NO. 10) |
| N1N2 | Forward primer | 5'-CGTCGACACATTATGCCATC-3' (SEQ ID NO. 11) |
| | Reverse primer | 5'-GAGGGGTCTTACCCCATTGT-3' (SEQ ID NO. 12) |

Example 1 Preparation of Plant Materials and DNA Extraction (1) Backcrossing of N Introgressed Segment Coker176 (NN genotype, which is negative for the GL4.06 primer pair and positive for the TN5.51 primer pair) and Yunyan 87 (nn genotype) are planted. Coker176 pollen is collected during flowering and pollinated to the emasculated Yunyan 87 flower, to obtain the F1 seed (Nn genotype). The F1 plant were planted. F1 pollen was collected during flowering and pollinated to the emasculated Yunyan 87 flower to obtain the BC1F1 seed (genotype Nn:nn=1:1). BC was seeded, and TMV was inoculated during the seedling stage, and a TMV-resistant plant (Nn genotype) was screened out. During flowering, the pollen was collected and backcrossed to Yunyan 87, to obtain the backcross seed. By continuous backcrossing, 5 grams of backcrossed 3rd descendant (BC3F1) seeds were obtained. A plant comprising the N introgressed segment as long as that of Coker176 type was screened out from the BC3F1, and named as Y87N.

(2) Screening of TMV-Resistant Plants 4-5 leaves of tobacco seedlings of BC3F1 backcross population were planted in a 32-well plate, 1 plant per well. TMV was artificially inoculated, and the inoculated leaves were detected to determine whether hypersensitive reactions (lesions) appeared in 5-7 days after inoculation. 5000 individual plants with lesions were selected (Nn genotype), and young leaves were collected for DNA extraction and for screening of plants comprising the short N introgressed segment.

(3) DNA Extraction

DNA was extracted with DNase plant 96 Plant Kit (QIAGEN, Catalogue no. 69181) with reference to the reagent instructions.

Example 2 Screening of Plants Comprising a Short N Introgressed Segment

A TMV-susceptible tobacco variety Yunyan 87 was used as a susceptible control. A TMV-resistant tobacco variety Coker176 comprising the N introgressed segment was used as a resistant control. The TN5.51 primer pair was used in the PCR amplification and the amplification product were detected by electrophoresis, in which the genomic DNAs of the tobacco to be detected, of the susceptible control tobacco and the resistant tobacco control, were used as templates.

The PCR reaction system is as follows:

| | |
|---|---|
| DNA template 50 ng/μL | 2.5 μL, |
| 10 × PCR buffer | 2.0 μL, |
| dNTPs 2.5 mM | 1.2 μL, |
| primer pair10 μmol/μL | each 1.5 μL, |
| Ex-Taq DNase 5 U/μL | 0.3 μL, |
| ddH$_2$O | balance, | wherein the total volume was 20 μL.

Those skilled in the art should understand that the expression "primers pair 10 μmol/μL, each 1.5 μL," means the concentration of the forward primer and reverse primer in the primer pair was 10 μmol/μL, and the amount was 1.5 μL. The primer pair was TN5.51 primer pair.

The reagents used were purchased from Takara Bio.

The PCR reaction procedure was as follows: pre-denaturation at 94° C. for 5 minutes; 35 cycles of denaturation at 94° C. for 30 seconds, annealing at 55° C. for 30 seconds, extension at 72° C. for 30 seconds; and finally extension at 72° C. for 10 minutes. The PCR amplification products can be stored at 4° C.

Electrophoresis detection of PCR products: electrophoresis was carried out with 1.2% by mass of agarose gel at 120V for 25 min, EB staining was performed for 10 min, and the gel was captured and recorded. The results are shown in FIG. 1.

PCR amplification as performed according to the reported method with N gene-specific molecular marker N1N2 (Lewis, R S, S R Milla, and J S Levin. Molecular and genetic characterization of *Nicotiana glutinosa* L. chromosome segments in tobacco mosaic virus-resistant tobacco accessions. Crop Sci. 2005, 45: 2355-2362.).

The plant detected as negative for the TIS 5.51 primer pair and positive for the N1N2 marker was screened out from the tobacco plants, and then TN4.99 primer pair and TN5.20 primer pair and TN5.34 primer pair were used to estimate the size of the deleted genomic component of the plant.

The TN5.51 primer pair was used for amplification. The resistant control had 845 bp amplification product, and the susceptible control had no 845 bp amplification product, indicating that the PCR amplification was normal. Then, the chromosome crossover plant comprising the short N introgressed segment was screened according to the following criteria: If the plant was detected as positive for the N1N2 and had no 845 bp amplification product, it was preliminarily determined to be a chromosome crossover plant comprising a short N introgressed segment; if the plant was detected as positive for the N1N2 and had 845 bp amplification product, it did not involve the chromosome crossover of the N introgressed segment. The results shows that 5000 plants exhibiting lesions were screened out from BC3F1 plants of 11,000 Yunyan 87×Coker176 by inoculation of TMV. The leaves of the plants exhibiting the lesions were collected, and DNA was extracted. Three plants, such as 15-7F and 99-2D and 24-8H, were screened as positive for the N1N2 and having no 845 bp amplification product by TN5.51 marker and N1N2 marker detections. These three plants are chromosome crossover plants comprising the short N introgressed segment. Three plants were self-crossed, with the seed thereof being reserved, and back-crossed with Yunyan 87 to obtain seed of 15-7F BC4F1 line and 99-2D BC4F1 line and 24-8H BC4F1 line.

Example 3: Detection of the Reduced Size of the Non-Target Genomic Components Linked to N Gene A TMV-susceptible tobacco variety Yunyan 87 was used as susceptible control. A TMV-resistant tobacco variety Coke 176 comprising N gene was used as a resistant control. PCR amplification was performed, and amplified products were detected by electrophoresis, wherein DNA of 3 plants positive for the N1N2 and without 845 bp amplification products, genomic DNA of the susceptible tobacco control and genomic DNA of the resistant tobacco control were used as templates. The PCR reaction system is as follows:

| | |
|---|---|
| DNA template 50 ng/μL | 2.5 μL, |
| 10 × PCR buffer | 2.0 μL, |
| dNTPs 2.5 mM | 1.2 μL, |
| primers in the primer pair 10 μmol/μL | each 1.5 μL, |
| Ex-Taq DNase 5 U/μL | 0.3 μL, |
| ddH$_2$O | balance, | wherein the total volume was 20 μL.

The primer pair used was TN4.99 primer pair or TN5.20 primer pair or TN5.34 primer pair.

The reagents used were purchased from Takara Bio.

The PCR reaction procedure was as follows: pre-denaturation at 94° C. for 5 minutes; 35 cycles of denaturation at 94° C. for 30 seconds, annealing at 55° C. for 30 seconds, extension at 72° C. for 30 seconds; and finally extension at 72° C. for 10 minutes. The PCR amplification products can be stored at 4° C.

Electrophoresis detection of PCR products: electrophoresis was carried out with 1.2% by mass of agarose gel at 120V for 25 min, EB staining was performed for 10 min, and the gel was captured and recorded. The results are shown in FIG. 1.

TN4.99 primer pair, TN5.20 primer pair, TN5.34 primer pair and N1N2 primer pair were used for amplification, respectively. The resistant control showed amplified products of the tested primer pair, and the susceptible control did not show amplified products of the tested primer pair. This indicates that the PCR amplification is normal. The genomic component of the plant with chromosome crossover comprising the short N introgressed segment is then evaluated according to the following criteria: If it is negative for the TN5.34 primer pair, the genomic component between the genes corresponding to the TN5.34 marker and the TN5.51 marker was deleted from the plant. If it was negative for both the TN5.20 primer pair and the TN5.4 primer pair, the genomic component between the genes corresponding to the TN5.20 marker and the TN5.51 marker was deleted from the plant. If it was negative for the TN4.99, the TN5.20 primer pair and the TN5.4 primer pair, the genomic component between the genes corresponding to the TN4.99 marker and the TN5.51 marker was deleted from the plant.

The results show that the 24-8H plant was detected as negative for the TN4.99 primer pair and the TN5.20 primer pair and the TN5.34 primer pair, and positive for the N1N2 primer pair. The physical distance from the marker amplified by the TN4.99 primer pair to tomato chromosome 11 was 4.99 Mb, and the physical distance from TN5.51 to tomato chromosome 11 was 5.51 Mb. It was estimated that the 24-8H plant was shortened by at least 0.52 Mb (the physical distance of tomato chromosome 11), Since the genomic size of the wild species N. glutinosa is estimated 3 times larger than the tomato genomic size, it was estimated that the N introgressed segment of the 24-8H plant is shortened by at least 1.56 Mb. The results show that the 15-7F plant was detected as negative for the TN5.20 primer pair and the TN5.34 primer pair and positive for the N1N2 primer pair and the TN4.99 primer pair. The physical distance from the marker of the TN5.20 primer pair to tomato chromosome 11 was 5.20 Mb, and the physical distance of the marker of the TN5.51 to tomato chromosome 11 was 5.51 Mb. It was estimated that the 15-7F plant was shortened by at least 0.31 Mb (the physical distance of tomato chromosome 11), Since the genomic size of the wild species is estimated 3 times larger than the tomato genomic size, it was estimated that the N introgressed segment of the 15-7F plant is shortened by at least 0.93 Mb.

The results show that the 99-2D plant was negative for the TN5.34 primer pair and positive for N1N2 primer pair, the TN 4.99 primer pair and the TN5.20 primer pair. The physical distance from the marker amplified by the TN5.34 primer pair to tomato chromosome 11 was 5.34 Mb, and the physical distance from TN5.51 to tomato chromosome 11 was 5.51 Mb. It was estimated that the 99-2D plant was shortened by at least 0.17 Mb (the physical distance of tomato chromosome 11). Since the genomic size of the wild species is estimated 3 times larger than the tomato genomic size, as estimated that the N introgressed segment of the 99-2D plant is shortened by at least 0.51 Mb.

Example 4 Screening of Individual Plant Comprising the Short N Introgressed Segment and Detection of the Reduced Size of the Non-Target Genomic Components in 5FN Segregation Population (1) Backcross Breeding of a Population Comprising N Introgressed Segment Coker176 (NN genotype, which is detected as negative for the GL4.06 primer pair and positive for the TN5.51 primer pair) and 5F (nn genotype) are planted. Coker176 pollen was collected during flowering and pollinated to the emasculated 5F flower, to obtain a F1 seed (Nn genotype). A F1 plant was planted. F1 pollen was collected during flowering and pollinated to the emasculated 5F flower to obtain a BC1F1 seed (genotype Nn:nn=1:1). BC1F1 was seeded. TMV was inoculated during the seedling stage, and TMV resistant plant (Nn genotype) was screened out. During flowering, the pollen was collected and backcrossed to 5F, to obtain the backcross seed. By continuous backcrossing, 5 grams of backcrossed 6th descendant (BC6F1) seeds were Obtained. After backcrossing to 4th generation, one plant comprising N introgressed segment as long as that of a plant of Coker176 type was selected to self-cross to obtain BC4F6 seed, which was named 5FN. The TMV-resistant plant (Nn genotype) was screened out from the 5FxCoker176 BC6F1 population according to the method of Example 1, and the DNA was extracted.

The plant comprising short N introgressed segment was screened out according to the method of Example 2. The results shows that 9984 plants exhibiting lesions were screened out from 20,160 BC6F1 plants of 5FxCoker176 by inoculation of TMV. The leaves of the plants exhibiting lesions were collected and the DNA was extracted. The 1-1002 plant positive for the N1N2 and without 845 bp amplification product was screened out from 9612 copies of DNA by detection with TN5.51 marker and N1N2 marker. The plant is a chromosome crossover plant comprising the short N introgressed segment.

According to the method of Example 3, the reduced size of non-target genomic components linked to N gene in the 1-1002 plant was detected. The results show that 1-1002 plant was detected as negative for the TN4.99 primer pair and the TN5.20 primer pair and the TN5.34 primer pair, and positive for the N1N2 primer pair. The physical distance from the marker amplified by the TN4.99 primer pair to tomato chromosome 11 was 4.99 Mb, and the physical distance from TN5.51 to tomato chromosome 11 was 5.51 Mb. It was estimated that the 1-1002 plant was shortened by at least 0.52 Mb (the physical distance of tomato chromosome 11). Since the genomic size of the wild species is estimated 3 times larger than the genomic size of the tomato, it was estimated that the N introgressed segment of the 1-1002 plant is shortened by at least 1.56 Mb.

The plant was self-crossed, with the seed thereof being reserved, and backcrossed with 5F. The 5Fx1-1002 BC7F1 seed was harvested for the detection of the linkage drag phenotypes of the plant comprising the short N introgressed segment, i.e., detection for the yield of plant comprising the short N introgressed segment and detection of chlorophyll content in the upper leaves during the mature stage.

Example 5 Yield of Plant Comprising the Short N Introgressed Segment and Detection of Chlorophyll Content in the Upper Leaves During the Mature Stage 5Fx1-1002 BC7F1 line (½ of which is plant comprising Ns segment), 5FN BC4F6 line (homozygous N segment) and 5F (nn) were seeded. The N-gene positive plant, that is, the plant comprising Ns segment in the 5Fx1-1002 BC7F1 line, were screened out from the 5Fx1-1002 BC7F1 line by PCR screening with the N1N2 marker before transplanting. The plants were planted in the field, topping on the same day during blooming. 18-21 leaves to be collected and can be cured were maintained for each plant, and the middle of the third leaf counted from top to bottom were sampled. The measurement and sampling were performed every 7 days from the 5th week after topping, and sampling was performed for 4 times. Leaf tissue with a width of about 1 cm on both sides of the leaf midrib was drawn with a blade and collected, wrapped with aluminum foil, frozen in liquid nitrogen, and stored in a refrigerator at −80° C. Chlorophyll a, chlorophyll b, lutein, and β-carotene contents were determined by HPLC. The method of determination was according to the standard of the tobacco industry (Determination of plastid pigments of tobacco and tobacco products by high pressure liquid chromatography according to YC/T 382-2010). The yield was determined by a conventional method. The results show that the yield of 5Fx1-1002 BC7F1 line was increased by 3% and the chlorophyll content of upper leaf during the mature stage was decreased by 3%, compared with that of the TMV-resistant tobacco plant 5FN comprising the untruncated N introgressed segment. The yield of 5Fx1-1002 BC7F1 line was comparable to that of 5F. The yield of 5Fx14002 BC7F1 line was higher than that of 5FN. The chlorophyll content of 5Fx1-1002 BC7F1 line was comparable to that of 5F before the upper leaf was cured. The chlorophyll content of 5Fx14002 BC7F1 was lower than the chlorophyll content of 5FN before the upper leaf was cured. The linkage drag traits of the TMV-resistant 1-1002 plant comprising the short N introgressed segment were significantly improved.

The basic concept, main features, and advantages of the present invention are indicated and described above. It should be understood by those skilled in the art that the present invention is not limited by the foregoing examples. Examples and descriptions above only illustrate the concept of the present invention. Any modification and improvements are intended to be included within the scope of the claimed invention, without departing from the spirit and scope of the invention.

SEQUENCE LISTING (13 sequences)

SEQ ID NO: 1 - DNA, 18 bp, Artificial Sequence
  GL4.06 Forward primer from Nicotiana spp
gatcccacgagtggagca

SEQ ID NO: 2 - DNA, 20 bp, Artificial Sequence
  GL4.06 Reverse primer from Nicotiana spp
tcctcaccaaacccaacttt

SEQ ID NO: 3 - DNA, 20 bp, Artificial Sequence
  TN5.20 Forward primer from Nicotiana spp
cgactttcaaagggaatcca

SEQ ID NO: 4 - DNA, 20 bp, Artificial Sequence
  TN5.20 Reverse primer from Nicotiana spp
tgcctgccaagtgactacag

SEQ ID NO: 5 - DNA, 20 bp, Artificial Sequence
  TN4.99 Forward primer from Nicotiana spp
tgccacacagggtgactaga

SEQ ID NO: 6 - DNA, 22 bp, Artificial Sequence
  TN4.99 Reverse primer from Nicotiana spp
aagcaaaactgtgtcattaggc

SEQ ID NO: 7 - DNA, 21 bp, Artificial Sequence
  TN5.51 Forward primer from Nicotiana spp
ttcgggtttttagttcggttt

SEQ ID NO: 8 - DNA, 20 bp, Artificial Sequence
  TN5.51 Reverse primer from Nicotiana spp
aggcaccatgtcacaaaaca

SEQ ID NO: 9 - DNA, 20 bp, Artificial Sequence
  TN5.34 Forward primer from Nicotiana spp
cactttggcctctcacacaa

SEQ ID NO: 10 - DNA, 23 bp, Artificial Sequence
  TN5.34 Reverse primer from Nicotiana spp
aaacttgttcatagtctgcgaat

SEQ ID NO: 11 - DNA, 20 bp, Artificial Sequence
  N1N2 Forward primer from Nicotiana spp
cgtcgacacattatgccatc

SEQ ID NO: 12 - DNA, 20 bp, Artificial Sequence
  N1N2 Reverse primer from Nicotiana spp
gaggggtcttaccccattgt

SEQ ID NO: 13 - DNA, 1404293 bp, Nicotiana glutinosa
ttaaagcaaaaggcgaattaaagctttgcgagaagccatgaaaaattctgttaagttgattctgcagacttacctattgttagagcaaagccgaaataatacctttatactatattaacaaaaaaaattctatcgcacacagaggcactaggaggcaatgtagtaaagtttcttagaatgaagtaaataaaataaaacttatgcaattctttaactatttttcttatggtgaaataaaaatatctatgtcccgaaactgaattaaaatagctaacatcactctaaagcaattataataaataatctgacaaagtagggaaacaatatttactagaggaaagtcaatatataaagataaaaagtaagattcttactgatcaagtttatgcaaattatcacaagagaagcaatatccaaatcccacaaaaaggtctacgtaaactcgatcaacatgccacgggattgaacgtgaaattacgttgaatgtgccaaataaaagccctcattttcatatatatgtagaagctcttagcctttatataatctcaccaattgaatagataaattaatctcatatttaataatacagagcttcatgaaattaatggaattaaccaagatatgatgttaactttctagtttctaaacctcaaagataaactatacaacaacttattttaatttaaaaacgaaaccttcaagaatgctttatattttatagaagctaaactttgtgactaagaaatcttcatattcaaaaataacgtagacattttcatatttaaaaataatgcaaagacaatagcttgtatctcaacaaacaaatccagaatataattaaaatctttcacagattattgtgtacataaaataactaagcaagaagggaataaaaacctttgcagtgaagcttttcaatatgttttgataataacccgacaattacaacagagaggcgaaaattggaaccgcaaactggatcctcggactcgaactgaacattcgtctctcctagaattcttttaaaactctctaaaatatcttcttaatttttttttctcttaatatttgttttcttttcctccctcaacttttttttcttttttctcaatttccttctctttttttttctttctttcttctttttttctcttctccgttcttctttcttttttctctttctccgttttcttttttcttcttcttttctttctccgtttttctttttccttcttctttcttctttctctttttctctttctccgttttctttttcccttcttctttttgctttttaaggtttgtctattatttatagatgtgtgggttaatggtgagatgagtggggaaagtgggaagtgatgtgaaggagtggggtgaggcatgagtgaagtggggaagtggggaagttgggtattatttatttatttatttttaatattatacatacatacatatatatatatataccacacactatatatatatacatacatacatacatatatacacatacatatatacaacacacaacacacacacaacacacattatatatattattatatatatatatatatattatattatatatatatatatatatatatatattatatttatatatatctaaccaacttacttttagacttaaaaagaaattaagttagaaaaatccaatattaaaaataaatactactataacttacatttaaattagaaaaaaactatgtgtgtgtgtgtgtgtttatatatatatatatataatttctcctatttaaacataggaacaaatcttatattctaagaatgtgactatttttttttagtttttaattttcttaaataaaacctattaagagtaagataaaaatttaaaatattaagattagacctaaaagaaatatttacaccaaaatagtatagaatttgtagtggtcaaaaattagttgttcacaatgagccgtgggcgcgggggtcgggtttggccaatttcggaaatttgatttaatttgataatttctatgtgggcttcattcctttagcatatattaatgataatatactaatttctgatagattcagggtgatttgtggctgagtcgagcggcaaggcattgcagagtacattttcgtcctgtttgaggtaagttacgattgtaaatctagacttgagggtatgaaaccccggaatttcgcactatttcactacattgaggtgacacacatgctagatgacgggcgtgtgggcattcgccgttaaggatagtgacttggtctgtcccatagcaactatggagtgacatattttgattaagctatgtaatttgctatatgttttagaaagaattcatataatttgggttgaacgccatgtttggggccttgtgcttgtactgtttggacccacatgggtattttatactatcctcacactgtattgatttgaaagcatatcctcagtcatgttttttcctgtttacagtttaattcagtttcattactctattttaaatatatgaaagttattttgggctgagtcccctgattttttttactgaaacgcccgagtggcttgtgaggttgatgactgaatgaggccgagggcctgattgtgaggatatatggatcggactgcacgctgcagcaataatttatatatattatatatatatatatatatatatatatatatattaatatattatatatatggatcgggctgcacgatgcagtgatatatggatcggactacacgccgctgcgatattggattgggctgcatgccgcttcgatatagcgcttgggctgtaggagcctttccggagcctgtacaccctcagtgagcgcaggtacctactgagtgtgagtgctgagtgatgagtgttgagtcatgagtgactgtgaggcttgcccaagggctatttatgatgatactttgcttgaggggtttgttcatgaaatcactattttcactctattttttatattgagcctctattgaaattgctgaaaatgtttttatatgattttcattgaaactcgagtcctcgagatatttggatttggatactgacttggtctttgttgttttcactgagactctacgttttgaacttcatgtgattttactgctcgtcactgcactcagcctttatttatagttgtaacttactgagttggtttactcacgttactccctgcaccttgtgtgcagatccaggtgccaggagatccgagtgagtgttgattcttcctcagtttatcccagagcttagcaaggtagttgcacgacgaccgcaaccttgctttctacctcctatcttctagttgttcatttgattagacttctctagtcatttgagtagactgtatcagatttgtattctagatgctcatgactatgatcgacaggtcaggccgttgatttttatgtttgtttattttcacttattttgaagtgtttaatgaaagatttatgctgaaaaggattagtaaatgaattattgaaaagaattattttatgctttgaattacgaatcggctagcctagtactgcgataggcgacattacgaccgggacgattagggtggtgacataaaggatccaatttcatttgctgaagcatttttcgtattatattatttttgagtaactagcttagctggccttttgaatttctttcttcacctctattattgtttcgagaaagtatttgaaaatgatattaataattaatcaacaagtttcttatcatgtttctttaaactagcatgaactaacaacactcaatcaatcaatattaattttgttactctagcttgttatttaagtattcaactaggtataacaatcattgaatctgtttcaaacattacgcaattaaatagaatttaataccgtagtcatttcttctatagaaagtgactgataacaattttctataaataaaatgtccttaataattaatcattgatacgtgccaggtaacaatattaataattcaaaatagcataatatagcttcttcttttattccatttgagtatcgtacgggattctaattgttcccaataatatatatatataatataatatatcccggaatttattgcttaaattaatgatactttcgtctatttaatctcaaccttgatcattccatatgttcaaattttcaaaaaatggccactttgagccgaattttacaatctgcatgcactatagttttaggatatgggaaccaaatttcaagtcaagaaactgagaaaatacaaaagattaagatgaaaaaagaagataattatggtgaaatttgtgcttcatcttcattgtcagaaggatttcagatgccacttcattatccacgttataaaaagggagattatgagaagatggaagaatggaaattagacattcttctcaagcaatatggtttcttgaattttaatgggaatttggaagagaaaagaacatttgctatgggtgcatttttatggcctgatcaactttgaatatgcctttcttggtcgaaccaacgattttccgacaagtctttctctaaaatatcgcttctctagctatctatcatatggaaaaattaaatgtatatgtaaacttctacgagcggagcaactttttttttctcttttatcttttattagattgaaaaaatatggcatcgtagattataaggagaatcgtcctggggaagaaagttacttttttgtattaatatttgcattgtagtaatgaagtaatgaactttataaattaaggattcgaggtactttgtttatacaatcagacctctttataccagtatcactacatatctgtcatttagtgtaaaagctaacctcttatgaaaccaatttgtaggttatataatatatgttcttcgtaacagtattttgttataacagtcaaaaatctgaacaaataaaactattgtagagtagtttgactgatatgaatattacaaatatatgtaaaaaggaaatcttcattcttgaagcatcaagaccgaaaaagttataattctcatgaaatttgtccacttttatattatgaggagtttagttgtaagtgattcaaaatataatacaaacattcaataaagcaataccaaattctataacttgattatttcattcactctctcaaaagttataatgtttgttaataataacaaagaaacttttgaactgttgcatttcgattaattagatctattgccgagtgacgatcatgagtcaacattgtgaagataatttgacataaaacaaaactttctaaaaaatacataaatttcctaaaataaaccaaaacttaatccaagagccatatttgaccttgggccttgggccgtttaatgagtacacttccaacacacacttcaaagaggaagtgcaccgttagttattaataaactttagtctttagtctttaatcgttactttaataaacttttacctgctcggacaaaaatactcttctactcataaagtttaggaccaagtgtccttaacttatgaacttgttactgtaagttgaggattaggtgtccttaatttatgagcttgtaagtttaagtttaggaccacctgtccttaactttgaacttgtaactctaagttcaagactacatgtccttaacttttgaacttcgaatttcaggactatctgtccttaatttttgtgcttgtaactctaagttaagggctacatgtccttaatttctgtacttgtaactctaaggaccaagtatccttaatttttgaacttccaactctaagttcaggaccaaatgtcttaacttatgagcttgttactgtaaagtccttaatttatgagcttgtaagtctaagataaggactatctttcctttgtttttgaccttgcaactctaagttcaggactacatattcttattttttgaacttagaactgtaagttcaagactacctctgaattcagttataaatatttaatactctcctctcagatatggttccaaattgtcactattgatttctcaaattgtatgagttttctgcattcttttctttgtttaacgatctcatgcttcttccatgcctcacttcttagttttcatctgaattttttcatattgattattgtttatatttggccatctatgggttcatgtgaaggctctcgccatttagggtttgggaaggaaaatagataaaagaaagggtaacaccgtctttttatattaattttaatggactagtggctatttttctcagcattaaaaatattgaataaaaagtaaatatcactttaaaaagtgactaccccgcgcaatttttaccacttcaaagggtattataactattaatccgcgcaagaaagtgtttatatttggtagccaaaaaatatataaatttgtatataacatacataatatataaaatataaaaatatataaattttatatattttttcgactattatttttacaacagctatacaatttattttccctcttcttcaaaatgctataacaaacagcctcctaagatggtccaagccctatgatatgaaccagaaattttttgaaaaaaattaacataaataatcgcttattcagccgcttaaactaaaattgtcgcggaataatatatatatatatatatatatatatatatatatatatatatatagagagagagagagagagagagagagagagagagagactgaatttgaattaaatgataattttgaatttatagaaaaatttttaaaatttaaattaaaatgaaagagaagtttatcttttattatcatgttatcatacttaattcgattaatgatcatatgcaatcatgttaggaattttttttttaattatttaaatactacttcgcctcaggtaaaaaagaagaaaaaactacttcatataactataaaactcttttatatttaaaacccgataattatagtgctttaaaaccctatagcaggatttgaataaagcaaatttttttaaaataaatgtaataaatggggcacacgtctatatttatccagataacataaaggagtttaaaaattgaatacaagctcacttacatatataatgaagtaagcctacatgctggagaaagaaacatcacaaaaatccgtcaatactaaaaaaaatatttttttctttttgaaaagtgtttgtttgaagagtcaatttgtataaatggacatcaaacaaataacaaaactttggcgataaaattgttatcattaatttcaattaacaccttctaggaattgaagggtataagatgaaacctcttcatttagctgcagtcaaggtaatattgcaagggtatagtatttttttcattgaagaactgtagtttctaatcaagattatgtcaaaggtttttttctcgaattcaacaagagggatattagtttctaattgatagtttctatagcgattttcaaatgtaacaaaaagtatattttaaaaaaaattggtatggcgtgaaatatatatttttaaaatgtaaacaaattattcaaaacgagattattttttaaattataatattattttaaaaatgaaaagataggatatttttgaatttagtagagagtttttaaaattattataagagaagtcatatcgtagctaaaataaagaaactaaaatcttatgaaatatttgcataaatatccagccagatttattatttactttttatagctattatacataaatgaaatttcgatcacatacgattatacacatattatatatgaatcatatatataaattatacatccttcaattttttaaattaagtatttgggcgagcacatattttggttgattagatacagccaaagaaatatatgaaagaatttcaaccaaagactaaaaatataaacaaagttcttatgtagacaatttctattaaaactcatccttttataacgaaataaattattttaaaaaataaataaagaaaggcataaaaataagataaaaggaaatatatatatctctctatatatatatatatataaatttatgaaaaatgtaaaaaccataaataagagatgacaacaaaattttcttctatttcatctttgttgagtataaaaaatttggaacctaatcttatcaatttcaaaaaaaaattcaactcaaatacacatattataagataaggataccttagaatatattttttttaatttacatcgtgtgtcgtttttaaaacattactattactaacaaaatgatatgatattcaaatttgaatttaaatgcaaattgagtagtttgcgttgaggttaatccaagtatggtctcgaaaaaaaaactacttggtaatgttaagacaatatatgtaatgttatataataacaatcaactaattttagatttaataattcaagaacgaaaaacttgtatacgtagggtattcagaattcaaaatatgtgactagagacatcgataaacttaaaatggagtcattggccatgcacttggaaaccccctatttgccaaaagaaatgttggcgtacttctacactggatatatcgtataacccttttagagtattgatgaaacatgatagaacattcatattatcttgccggtcatactgaaataaagtttcaccgactaagaatcatttaaatttgtagatagctgattaaagtggattttaggttatgaataatatcttcacttgcatcactatatatataataattattgaaatatatataaagttttagaaattgaaattttaaattagaaatattttttttgaaagataacagcataccgaataagagttcaagttgtaataaatgaatcacgtcataaacaaagaatcgttcatattgtgtcaacatttatgctttgccataaatacgagttatttatttctctttgtggctattttaggttccaatgacacaaatgagaatggtgcaaaaataaaattatcactacgtgatttgagaaaatgttcatacttttcatgtagtgtgtcctaattattatctaacaattatctataaggttttaattttaatgttatttacatataattcaaatagctcagatattaaatatggttaatgtcaaatatcaaaatggagtcatactagaaaaagaaaattcactggctaaagaattttgtaaatttttagatagccgactaaaatgagttttgaattaagaataatgttttcacttatttattataaaaataagtattactgaaaaaaaaaatttagaaactgaaattttaaaataaaaatatttttggaagatatcaatacaccaaataagagttctagtagtataaaatagtcgagtcgtttcaaaagagtccttcatagtctaaacctttgattgttttgtgataaatatgaattattattttgattgctgactatttttaagatctatgacaccggcaagaatgttaccaaaagagaaaatagaattataactaagagatttcagaaaaatttaatcttttttcatgtagtgtttcttaattaatatttaataattatttttatttatcaagaaggtttaaactttaagattatttatatataattcaaataactcgaatatttgacatggttagtatttgtgcatttgcgtgaatactaatactaatatatatgtaatccttatataatatgtataatttaaatatatcagctagaaaaaataaataaataattccgacggactatttatgtagacatccgaattttgtacacattggccaaggtgtgagtcgtgaccactgatttcaattaagcttatcaccaatacctaatctcagttcaggtgcgccaaatggtgttcaatctctgccttccctgtgggctccgggattttctcatatctctttcaccaacctcattcaagactttttacaccttgtttggatggtcattacttattgtattgtattgtattgtattgttactttaaatttaatatttgttttaattttgttaagtcgtcgttacttaatgacaaaaattatcactttatggaacgatcaatttggtgtggttgcgttgtttccttatttttttctcttatcttaccttcttttattattaaataattttattttacttttaccttacctttctatataatagtattacctcctaccttactttttccttgtaaaatattgcaatttatttttcatattattgattcaatctatctagacattgtatatatcaaaacgaacagtacaatataataaaatattatacgatacattataaaatgatacataacaactattcaaacaagctaactctctttctttttcctattcaattacttataggaattttcttgccaaatacttaatacttatttactccatcatatttttttgaaggaccattcagttacttattaaatgggtcgacaaagcagtgatttctcaatcttttttgtttgagagagcctcccgtggcggagccatgatttttaatagcataataataattcaaaaaatgcaagaacgtaagatttgaatttttttataattatcttgagcattttggttaatttactaagtaaaataataagttagtcattctatatacgcctatattatgggaataataaatatatactctataaatataaaacaaaaatttatatattagtggttcttgtgaatgctagtcattatatttatacagggattataaatgtcaactgtccacttcacagtgtatttaatggctaagtgatttttcaagtagtaattgaattgaagtactaatccgtccggtctcaaataagtaattttttaaactttttattgtggttcaaaataaatgattttttcagatttcaagaatgaattaattattttttcctacattgtcctttaagtaaatgatgttagagtgatcttggacatgtaaataaattttaaacgaaaagatctgcctaggattgttattgtcccgctgcgtgttacgaacatctatatgcaattcttcagtggtatcagagcacaataaataacttgtcaattactatgacgatctcaggtcaaaggaaacccttacatcacattctccaagagaatatcatattgacagtttatggtaattctaaccattacgaattatccaatgagtcggttcaatgatcatatctctctatatgcatcatctatttatgtgatttagttaatgagatcaactaatctttatcccataaagacgatcacataaatattgatctagttggattactaatgtccaaattaataatactacgatcaaaaacaaatttagattaaattataagaaacttcactctcattatcatgatctccatcacgatggtaagtcccaaaatttaatcaaggatcttattaaattaatcaaacaactaataataactatgattaaagaatatcaaatgccatatattttatatcaaataacgttcacaaaaatatgttcaaatcatcaaatatgatattggatctgggcatatctactatatccctaacatatgtgttatgagtatttatgtgaagagataataaagattcatatggtcaatttcattactaattaatgttaaaagatggatttcttaatttatatgaaaacacccaaaaaatcacttattttagatcgaagcgaataataagtagtattgctgtaaatatcagctcagccgtagggttccttactcgatgtgacttaataaggagttttaatgaattttttactgcgtttgagaagcaatccgactagttttcatcgttaaaataataagtgctcgaaagacatttaaaaccaacagagtatttgtatatctctcatggattttccatacgccaaggctcgaactattcagatacatctggttaaaggataaaagtcctatctgttgtaccacattaaagggagcgctatttcgatataatcggactgcaatacatataccggacaccgagtgacaaaccaaaaaaattacctataaatagtgccactatgtaatattaagtcaaatttttctttatgctcataaactttttttcttttctttctcctgtttgacatttttctacaagttatgggatggaaaatttctggtatgaaatgcttccaatttttgtttcttccttgttaattaatcggcggtgatagtttagtgatcatttgcgtaatagactcgataagggagtagaggtaaagtcgtaaagagcaattagattggggtgatgcgtaccatacttcactagttggcttcccatcagcaatgaatgaaattaaatacgataagtctgccaattcctaaggttgattgatttctttcttatcagagcgcaaattggcattcattacttacccttcaaaagaatgcagtcattttcttgaagctgtaaataactaaaattcattaaaatttttagatgagcaaaaggtgacagaattaagtgcatttacctaagtttgaatttactataggatatatattcttcaacggaattgaacttctttctctaatcttgatcttaacatttttaggaatttgactcgttcatgaactactactactactagtatttattacacctcttcgatatgaataattatagcacattcaatagaggactttaatttcaattcaagcttggtctagaaccataacttctatatttaattaatttattaggtccctagacatatatatatatatatatatatatatatatatatatatatatatatatatatatatatatatatatatatatatgaaggatggaggcagtgatatgaaaggtggtcacagctagttactggaaaatggaggcagcagctataattactcgtatttgatctccatatcttcttcctccttatattattactccctgaaaaaggagagaacatataaccctttgaatgacaagtacgtgttacaacaagcccataaatccactagctacctaatatatatatatatatatatatatatatattatatatatatatatatatatgtttttttttttaatactgtatatgaacttctccttatatcaatggacactataaatttctcttatccctcttatatttacgtaccctcaacctaagtttgctgttactactactaataagtacaaattctgtaagtttgcttcatattcattcaggcactttattctgtttaatttccttcctttttcctactaaaaaaatttccaaataaagttttcattcaattaatcttttgcttgtcatggttcatttttttctccttatttgcagttccacgtactttggagaatacaagggctgaaattgaatgacaatgaagtgccttttcatggtctgtgtggttttgttgcttgtttcattctctggtatatttgctctcttctttccttctcccttcatttattttcctttagttgtatttgagttgaaggagagtcatgacgtaactggtaaagttgacctcatgtgaccaggaggtcacgggtttaagctgtgtaaacaacctcttgcagaaacataggttaagtctggacccttgtggtccagctctttcccgaacctcgcacgtggcggaaacttagtgcacgggctgcactttttagttgtgtttgaggtacatccatttggtcttttcttgcgtttcacctttgccggaaagagtaatatttctcaactccctgtcacttctgcagctcgtgctatcttttaattttaagaaattctttttttattttttaattcagaaaagataagtgaagttgggaaatctaaactaaagttactgcattgatatactaattattctacttccatgcatgtacccttagcttctatagggtttttttgattaatcttttggaatttatccctcttgtagtgtgatttccaactctatcttgaatgttctaggcttgaaaattataaagcaagtgttgttatctttttgaagataattaaggcactttggataaacatataggcaaaagcttttgaactttattaggataataaaatatgcagcttttctatttataattaccatccaataaccaggcgcaatgttaatctgcagtggcgaagatagaaatttactcaagggtatttaaatttgtaagaaatgaaaaaaatcccgacaaagagtgtttactatgtgttatatacctctaaaacgtaatattttatctatatacacagatcaccgtacagtacaatttttcgacgaagggtcaactgaccatcctcgtaaccatgtggctttgcctctgttaatctgggatttatgttttacaagaaggcgtagtaacttccaacatgagtgacagtacattactgcattttccaactccacttttcttttatgaagaaaacatatatttattctactgttatgcatgcatgtatatcccagtatttttttggttcatcttttgaatttttttccctcttggggtttgatcccaactctatcttgaatcttttaatgatgcagtaatgcacattaatcatgcattggaactagctgagaaacgtggtgctattcaagaaagaaccctaattcccaggcaaaaatacactgtcacttctgctcggaaattactacgccttcctggtaagacatatatcctcgatcaacattaattgtccctagtttgcatgcaacttggttataaataagctatttggctcctaatataatgttctacatgtttaactgccttattaattgttcttccaacatttgtactctgagtcttcttcgtcaaaaaatactaaaggaaacaatcaaaattaaccttttaaagttgataaataccaatcctgttatttctcagcttatgattttataaagtaaatcaaacgaatatgacctttttcaacccttattacctaggcgaacaattcacacattgcatgttaccggaggctaatccagaatttaaacctcatgagttcaacttttaagggttttagcattgaacctattatatttaaaattatgggttcatatctactattttcgcaattttagtgaatttttattctgcatcgaaagttatgatttcagttggacacgctggtagaacactacatccgcttctgcatgttgcatgaaatgtttaaaagatgtaaaacttagtaaactttactagaaagatcaaattcttgctgaaaaaaaggaaataaagttttatttattactatcatatacaacaacaacaaccacagaagtaaggggtctggggagggtagtgtgtacgcagaccctagtcctacccctggaatagagaggttgtttccaattgacgctcgactcaagaaaacaaaagagacagaaagagcctatgactgtcatatagtagttcaattttacttgtaaaacttgtattgtttgagcacttgaattagtagcttcattgcttgacttcatcttattcttgtcgcgagcattgaatagatattggtgatggtgatggcactggcgatgatggtactggtgatgacggtgatgataatggtaatggtgaaggtggggtgatggcgatgatcaaggcgacggctcagaaaatagaattggtccatcatcatgttcaaaagacagcatccaagtaaaccaaggtgacacagcgccacttccaaatggcattccaacatacacagtcataatagaaaatgcatgctactcaggaggaagttgcactgtgtcaacattcacttgagttgtggctggtttagttcagcaagactcataaacctagaattttcagaagacttagttataatgactgccttgttaatgatggagagcctctcaatcctggacaatccctcacttttcaatatgctaatacttttaaatatcctctttctgtttcttccattgcatgttagatgtgtagatggcttcttttgggatcttttcttgggctaagattagactgtgggtatgttatgccaagaataactcagtagtagtctttgtgtatggtgttactaatatttatcttagttcttgtaatttagttaatggcatcaatgtgaatagtgtgaattcctaattcttgggtcaaatctttttccattttgaaatccaaatgtatactgatgcagatcttgattaaaaaaccaacttgtgtttgttcttaattttggtgaaaattttatgtttcttgctataaattttgatagaagttggattttaatcagtataatactcgatttggtgttaagtcatttatctaaactagttttcaaagagcttattgtaacatattatgtggaggatatctactcaaatactgttatgtaagatgaacatagtatagtagtatatgggtaaaataataaaaaaagtaaatcttaaatatgtaacaaaagagtagcttttaggagctccatctaatttgaaaacaaactcaactaggatgtgtttggattgacttttaaacggatcaaattagcttttaagtttttttcagtgtttggcaaagtcaaaaaatgtttaaaataagttaaaactatttaaagtaagcaaaacaataagttgggcaaccccaacttattactttttggcttaaaagctatttctactgaaaagtcacttttttaaggcaatccaaacgctattcaacttattcttgggtcaatccaaacgctattcaacttattcttgggtcaagtgatcatttgaatgtatacatctattttgatttagaatttccttgacggctagcctacaactacgcctcaatccaagtaaattgagatcagttatatgaatcatcacagtttaatgtcgtttatttagtcttatttcaaacagaattgcaaaagagcattacggtataaaaacatttcgcattcacgcagtattcggggaagggctacacctaagggtgtgatgtagacagcctactctaatacaagtactaatggctgcttcgacggctcaaacagtaacctatagattaggcggaaacaactttatcattgctccaaggtcccttcttaaacaaattgcaaaataaaatcaaattcaatccatctaaaccttgattggaaaagatgatttcagcaaagagggaagcattagataccaaaatattagtggtgctagggaaggcaaattcacatagacaaatatgaccatatcaatagtgaactatgaagaaactatactaaaatagaatgcaacactatgagtttgaaggcaatatctattacttgctgaatttaaggacaaaggtatataatttgcattggattaaaaaaaaagtagccagtgcactaagcttccactatgcacggggtccggggaaggccgggctacaagggtttaccgtacacagtcttactcaacatttatacaagacactgttttcacggctccaaaccgtaactttaccgattccaccaaagcttcccttcataatttgcattggataaacaaggaaatacctatttatacagaaataaactgaaatctaatattataatcataagcaaaatcagtaataccaaccatagctgataccacttgagaaacaatataaaaactgcctcccataataaccaatattaaaattgcagaaattgggttcttcaacagctcataaatgggttcaaaacagcccaaagaactccagtactaactgtcaatgcataaattgcatatctcctcatattatcccaaaattcctccattaatggaccttctggacccaaagccaatgccttattttgatcatcaaatcccattaaaaacaacattaccccaacagatacagctcccaataccaaaagttttgagcttttctcatttaaaccagcttcagactcaaaattttcagttcttgaaatttcttggatttgtgcaaaatttgtagagctattggtttaactaagtttctttttttctgcagctagctggtgaatttctctcttcccatatggcaaattttgaggtttattaaggggtgaattgtgtttgagttggatgagcaatggaggattagagcgttggaaatggagttgaagtctcattttttgtttttttgagatagagcaatgaaaggttgtggtagtttgttttaaatgtacttattattatgccttatcttctttctcttaccttgaaaatgagaaacagattgagtttgggcccattgaattgcaggcccaactctatatcactctcttcaatataagcccacattgtcaaaagggacatgcagtttaccaaaatctagttacagtcaaacctctctgtaatagtttcgtttgttccaaatatttttgaatgttatagcgaagtgttgttatagagaacatatataataacataacatgaaaattgattcgataaagcttgacttttatagagaagtgtgtcatataaggatgttgttatagagaagtttgatatgtttgttgtgttcttttgtttaacaatctcgtattcaggaaattacaatcaatgactttgaaaatggatggtcttgatattacctcctttgccttatcgacagacctttaaggtcgaaagtcaaaagtattgcccatagaacaagcgaggggtaatacttgttaaactataaatcatgcccacggggcaaggagatcgaaaaaccaatagtggcgtcgaagtgtcgtagtttcatatcaccctttgctattgggtatcaactagtttgattaaattgaggttgctataaaggaagccgttctcatgttcaaatttgagatctctaattaagagtagaaggatttcatccattctcgttgaattcttagccgactgtagcaattaaggaaaggaaaaaaaggaggaaaagtacaaagaaaatgagatagaaaagaagaaatacaaagagaaatagcatatgaaaagggaaagaaacattttagtgagcataggaagaaatctatttcccttcatatttctttttgtcaaattaagcaaagggggagagaaaagttcctttataaattccaatccaaattagttaatattttacatgaagctgcgaatggaaatttaaaaatcaggtgctaagagtacatcgaaatttgtaaaattactcttgggtttttaaatatattaatgcttaaaagaggctgaatagaaaatggagggaaaattaaatattgaatttcatttgagatgtcctcgggatattgtcccatattgaaagagcaagaggtttttaatgggtatataagcagtagctcttcttttagctcttaaagagttgagaagaaggcaagcctcacgccttcgtcatcgtttcgacttcggattaattttttggaccaaatttatttattgataataaatattaacataaatattattaaatatccgtttaatcatcctcttcaattttccctctttattgttgagtaaatagccatttatgttatggcatttatgttatgattgttttgcaaaaatagccattttgaagagttgcacctcttcatatttcggcccaatattggctataaatataagtctatcctctcagattttctatacgaatttctgagttctcctcctttcttctgcatattttttacttcaaagaaaccaatagtaagtgtgatttgctaccgaactttgtgttcgctgaaacactggggttttaagtaccactacaccggtgtgtaattcgttctattctgggaggaaataatccataatcttgggtactaggaagggattaaatttcttaaggaaacactgtgaattcagtgggctcggattaacttttgtttcgtttatatttctgtttatgttattttattttctccggaattagtttacaaatacaatatagtaacaactacatacaagaatttaaggtgaaaatagcacgggctagtcagtttttagactggtaattgaaaaatagccaatgtttgtagagtcatttaaaaatatccactattttgctgcaacacgaaaaattccagcatgatataatagagattggtgcacatgtgtatgaacttccaacatattatgctggaactccaacataatatgagattggagcacttgtgtatgaactttcaacatattatactggaccaatatattatgttggaactccagtatattatgctggaagttcacatgaatacttgaactccattatattatgctggaatattttctggattttaaatgttcagatttgtctttacataaaaaatggctaaattttaattatttttaaaatataattatttttcatttaccacttataaatctgactatttttaaatttcacccgaatttaagtacaattggataaaaaaaaggtgacaaatggagcaattaaatttaatccttttatctagaaaggtactagaaaagatacccccccaaaaaaaaaaaaagaattgcactgcttacttgaaaaatgacaagtcaatcaaaatttatttgaccacaattttcttaaacaaaatttactgtaattgagattagtacatgtaaaaccatatttaaaaaggatttaaaagtttagtgttaaaattaatccatctccttaatttatgtgaaattcttttctttttaatctgtcctcaagataatatcatatttttatttaaaaataacttaactctaaaattttattttacatgatttacagtcacagaagataattcttttttccaaaactcaaaagcttcagttggagtagtagtccatagttaaattttgtttcttcctccggtttgctgctcccacatgtcactgcggcactaaggaatttcaagcccctgcaaccacttggccatggctcttctcttttccacctctatttttcttcttctttttcttcttctccatttcctctttattactactattatttttccttaaccgtcaccgcttgttgaagaaaaaagcccaactcatcacctttctctggcttttcccccaaaaagatacaatctttttgctattttcaggtcagttactgagttacgtacttacttttttcccctccttgaattctgccttctttttttgggttcttttttgtttcttgtttccatttccaaccctaagcttatttgtgtgtgtgatcacttaatgtctggtcaatgctgtttcaatgttgtatgtttatgttcttgtatatggtttatcttttaaaatcagcattacccattttgtttctcacgtgggttttagcttcattgttgtttttcatttgaaaaaaaaaaaccctgttctttgtatctgatattctgttgacagctttctggaataaggttagttaatctttgaaactaagccaaaccctctttgtgcttacttgggtttcgtggttttgatgctgtttttccgttgtttagatggttgtcaggagctaatcgttggaaaaacatgttatttgtatctgatgtttttatttgataaaccaagaaaacccaaggtccagtggcgcaaggtttaaactccagtagataaagaaagtccgcccctttacccttctccactttgaataccaggcctatgatatgcgcctaactcaaatatcacaagttgagctcttaccgctaaacccccgagggctggaaatacctgttctttgtatttggtgtttttagttacaaactttttgtttgttttaataggtgtaatgttttgccactttttgatcgggtcctaaattgtgaaagagcttagtaggattatgcttgctcatgactctttagcctgaaacgattgtttttgtttcttgaaaaaaacattgtttatgtttctggatgagggtgtttaggaaatgtggttgttttcgattaatccaaactgtttgtcctctgtgtaaatcaggatggctgcagataatcatgtttttgttgcgtgggaagagcgggttatttctcaagagaagggccatcgtgttgtgcactactacttgaagggtttctcgggggagtcaatccttgctgtggtgggtactgaaagaagtataaggcacataacatatgttgtctcagaggattatttggatgcttttgggcatacaagaactataaattctggaacaaagtggcgtacaagacgagaggtagtggaatggctgacgtttttggtttcaaagcgtcgccagtcatcacctatttcaagtatgtataatcatgttgctgtctaagatttcagttacatgagatttacagtattattggcataaatgtacattgaattgctctagtttctggtatttagcattttcggaagaagttgacaatagatcattggctgctggttacacctgatcaatgcagagaaggcagatgttttatgatcatgtttaaaagcaaaaagttctgcgaatgtccaaactatctccttgatgggttaatctcagtctcacttcttgtgaacttttggtttgctacagtgctttgctaattaattcgtagatgaaaaatccttttttgatgaatcgtagatgaaatatattatgctttgacaggaaagaaactgaattatgtctcaattattgtttccatgaagaagcctcctcccgagggttattggggagggagcagagagagatggctgaacaacatttccggttccttttttattttgggatttttgttctggacttcagttttccaggcacaaactgaattttcaatttacttgtgtatctagatttaacctagagtggtggaatgatggtagttctttgtatcccagggatggatgatccttgtttgaagaatatatgggaacgtatcttcctaagtaactacctcattatgcttttttgcaaggaaagtatactttgtgctccttgttctgaccacagtcgcctgtgtgttgttgtactttcaaatgtgcagcacacaagtttgtggtttagtataatactttgagaacgaggcttttcttcggctgatttgaactttacaagttgtggtgataataggagaaataatttgataaataaggttacacccgtccagcaacatgatgggtcattcgatcctaaagcctaaagtacaacgtgatttaaacttcaactcccccgtttaattgttgaagcacataagttaatatagaacgatagttatgaccactcatgttgacgtcttaacactagctaccagttgtgttagcgagcacgaaaggaaacctcctctttttatgtttctcttgatctggagctttggagtttgggcttgacatggtattttgtgcttccctttttgggaggctctactatactctcttcacctgttcaccaggcaatagacaaatagtcatacagattatggtttcgttactacttgcccatgtaaagtactaaacttattgttaacactatgttgcctttatttaaagtaagtggtctagttttactgcaaagccatgtcctcctgaaatatttgtaattaagatactttatatctcacaagttttttgtgttttgtgttagttaccaaaaagcatcaagtatttagtggttacattagttgtgaagtatttataataaatgaccttggagttgtttaggactatgattgtataagtggaaaaagccctacactaggctgctaaggagtcggcttctactgtgagaaggtttagatgccatatttatgttatcatgatctggtgattttcagcatgtgtatagagaggaagacttctaaaagtgaaaatatacagttcgaaattggatcatgtaataatcagttggccaagaagcaattgctcatgcatccaatacgcatgtcgagtgattctcacgaatttattttttacatgtgatgttaaaataaattaaaaagaaaaggagtcaaatccagggtggaggcgcaactcctattatgctattggttagttgttgttcaatagaccaaattcagcaatagatattcacacctcgattttgcatttcctaacatcttaagattggaatcatactttaatcatggttaaattgacacctcactaagaaacaattttttttatgatgtcattaacatcatgaaagaaaaattcctttttactgattcgacattaaattatttaaataaattttaaatgagttgttttaagaagatcccccacactcttacttcatgctacgtgattgatgtgttatggagattaagaagggaactatctctaggtatcgagctggtaaaaatgggacgttatagtaaaaaagttgaggagaatcctataggaacaatatagtatttaattgaactgtgatgtaattatttaaattgttgaaaagttgtgtagaaactccgcctatgtgagttaatgtaatacattgccggtcccaaatccggataaaaaaggagtcgaagagggctgtagtaggttgaggaccactttaaaatgatcgaatatgatggtctatatagagtggagttggattcattcgccaaatggaaagatttgaagtattagattacctgaaatctttacaaggaaaaagaattgagtttggaaagggtgcaattgcgtaataccaaaatgcttactcctgtgtgtttgactgcactagtggtggagataatacaaatacaatcatcactagtatctgtggagtctcagcaggtgtatctgaccttctgagtccatcttttctcttttcatagtatttgtgttgcgcggagaagagatcgcggtaaaaagtttgcatctgacgatcaaaaaaagaaaaaactagatcgaggtaaaagtgttgatacctggagatatctgatcttagagtttcgttatccttctatgtctatataacattaaaaattgtatatcttttttccggttttccctgataaagtcaattttaactctttgacagacggggaggttacagttctcaggccttttgttttgtcagtatctgttttgattgattggtgataatcaaagaagaatgtagttttgatgcttgatgatcttaagagtttctaacctttgtttctattactttaagtaactactttggactttcttaggtcctcctgttctttctgggggctaattggaacaaatacatctttttctttctcgatggataacactagtacatctttttgcgtggttttggccaacaacaaatagatatcatccctgctctaatgtgcaagggccccagtttgacctctttcaacttccaccctgaaggagaaagaggctaaatgcaaggaaataatccttggttcctggaggcggtgcgcttccctcagggaagagggagaaggtcgattggcccctacgtagggttgtggcggcaaggaagaattaatttttatgcaattgggatgttttatataagcaaatgatgcggtcacaatttgtctgattgtgatcttggtgctgtctggttgtgatcttttgcatttccaaatagggtagaatctttaatagacctagactcctagtcaatacgaatctgccctgtgctttttacactactttggtatttgacttgaatggtaaactttttctcattttggtcttttgcttcccttttccatttctccttatgcatctacgcagtgatccttaatatcatgcatgtttggcaatcttattaatgttgaagaatcggattgcataatcttgctctgttgctttccttttcaattgatatatatgttctgtgttgtgcttgatgttcttgtacttccaagtatgaccctaattcaataatactcgactttagaatagattttctttaaggaaatgtaggctaggcggctgaactttgttaaattaatgtcctttaattatagctacttgtattgcttgaatgtggtcgaaggcaggagagttttccaattatattccttgtttcagctaatacaaagatagggaaagattatattacacctgatacatgatctattccatagcggcctgtggaatcgtaggccttgaacgctcttgttcttagctgaattcccagtaaattgctgtttcagctgcaaagttgttatttgctttccgagttgtgtgatgctgggtacagttaaatctctgcttaaagaatggttgcctaatagttataattgtttttttcttaatttaatccgctttacttttagtaaatttgacttcccttctcttgcagataccctgacaagtgaaacgagaaattctttagtggctggtttacctaataggggatccacatagctgacgaggtctcaaatctgttgatctattctttgagattagtttcaactttgttaaactacatttaatgaagggaaaaatatctattacagggcgagcttcctagaaaattgaaggccagaaaatcaaatattttgtggtcagggactgcttggacctgctcccagcaacttaagcattatccttctttttacagggaagggactaaaatagctgtaagcactttgtagcattaaatcagttccttgacctcatatttcttttccttcctcctttaacttcttagttttctgcagattaattcctttgcgaaagtcatgggcgaagaagaaaatcattaccttggttacttggaagatttatatgagaacaagaaggggcagaaaaaagttaaggtgcagtggtttcaccatattcagaaagttcgatgtgtaattcctcagcttgagggacaccctagagaagtttttatcacatctcatgttcaggtgatcaatgcagagtgtattgatggccctgctgcagttttgactcctagagattatgagaaatatatctctcttgtcccaaaaagctcgtcttctggtgtctacatgtgctttagggaattcagacacaataaggtcatgccagtctctctgagtaaattggatggctactataatcaagcgatatttactgtgttacgcagtcaacaagtttcccagcataagtcaaaaggtcataagttgcatgaagcaaaacatataacccatgaagatcctttagagcgaggaccaaggaggagtacaactgtcaagcagtatccaaaagtggagaacagccattctggtatcagaaagtcaattcctgggaaccagatagcaaaagccgaaccaagttgccaaaagttgaaaataaaattgtcaagcagaggaccagttggaattcagcttgttcggcccaaggtccaatctaagctgttttttgaagttggtgacaacatagagtttctttgtcaggacagtggcatgagaggctgctggttcaggtgtaaggtcttacaggtcttacataaacgtctgaaagttcagtatgatgacattcaggactgtgacggtctagggaagctagaggtaccataatcacggcgactataattcagtttatatgcagtaattttcgtaaatacaaaaaggagaaaatttgaatctgttctacgatctacttgcatttatgtcaaaaatatatattgacctgtccttcctttaccctgttttctgacacctttgcttgatttataggaatgggttccctcctccagagttgcagactctgataagttgggcatgagatgcacaggacgcttcacggtccggccccagcctccggaggattcttctgatctttcttttgaagtaggagctgcagttgatgcttggtggtgtgatgggtggtggaaggtgttgttgctggatttgatgtttgtggaagtggtcatcttcaggtttacttccctggtaagttcatgctgtcaaaagatggattcctcccccccccctcccccccccccccttctactgattaagatatagcagtctcaaagagcaccaaaaaaactaaaaagttaaattagaaatacagaacaagaataaaagcagaattctcgcttattggttgatgcggcatagcatcttcttataaggaactaactctacagcctatggatgtaacattggagtttccaattacttcaaatctgacttgaaaccataggtttaagctcagcattgtcatctgacataggagtggaaaagctgataaagtaggcctagcttctgtctaatttgttgtcggaattctggatgttcaatgtttgtcatgacttgacgtcccaaagtattatttttttcaataataggtgagaacagattgttggaacttcaaatgaagaatgtgagggcttcaagagattggatagataacaaatggattgaagttaagcgaaagacagacataaagtcattcataagctcaagtttaactgaggtatccaagtgcagtatcaaagttgagtcgacgtctaaatacacaatggagaagcaagatagcaatgtggctcctaaactgaaaagacgatggcgaatgattatcttgaaggtaagaagaactgatttcagacatgctacaggtgataactatggcgtctaggagtcaatttttgtgatagttttgaccacctctactaatggtgaagccatagaagcaggaagagagtgacaaattaatgcttttttggcactgtgggtaaaattttttgacttgtaagtaactctcagcagtgccccatttgctttttttaaatatataggccttgatataaaaagaagaatttacccaaatagtcgcccaccctacttcttaaactaaaaatagtcggtgaatatatagtatatgcataatttatgtattacatgtgtataataaatgtatatggctagaaaaaataaacaaatacagcctgtttggattggcttaaaaaaagtgacttttcagcagaaatagctttaagtcaaaaaacaataaaaattgggattgccccgcttcttacttttggcttgttttaggcagtttttaacttattttaaacacttttttattttaccaaacactgaaaaaagctaagagcttaaaacctgagttgaccaacttaaaaaccaatccaaacaccctcttaatatgactgactatttgtgtaagatcccttattcctttccatactatggaaagggaggctttatagaacttagggactataggcaagcaatctccttgcattaatgcagtcagacctcgataacatcattatataacagtaattcactataaaagttaagttttttatggaaccgatattcatgctatgattgtcataatatatattctccataacaatatttcgctattacagcaaacaatatttgtatccatcgaacacatactcttgtatcatgcactctcagaccaagtttatattcttttattttcccacgtatgtcttaaaaaaaaagaaaaatttgttggtaaaagtctataactttagtttgtactactatagctcagaactctttaaaaaatggttattgttatatcgtgactaacaaacacgagtaattatttatgataagggtactaagacgatataccaacttaagtaaaagacaattaaataacactagaatctatatatttaataatggatgaaaacaaaatactttatgtcaaaacgaattagtaacctcaatcgagtaatttgagcaaaaaggacattgtcaccgaatttagatatgatgtggtgaagaccaagtttatacttttttgtaatttttcctatgtactaaataacattattatttaggtttataattttttgtggcaaactaccttatatagtcgctccaaaaatagtagcccaaaaaaaaaaaaaaaaatatatatatatatatatatatatatattatatatatatataattaatgtatattttttgtatatttgactagtgggtgtaattatttctggccaacttgcaaaagttgtagcttgccctttttgttgggagaaattaaaaaatagttagatttacaaatagtcagtcaaaaattgccacagtttacaaaactaatcgaaatttagccacttttcatgtaaagataaatctgagcgaaacactgttcaaaatttgaaaaatactctagcattatatactggaattccggtataatactccctctgttctagtttatgtgaacctatttcttttttggtccgttccaaaaagaatgacccctttctaaatttggtaacaatgctaaacttacaattctaaccttaatgagaagcttttataatcacaaaaatactttgcgtccctttttgacttgtttaggaccacaaatttcaaaaatcttcattttttcttaaactctgtgtgaagtcaaacaagttcatataaattggaataagggtgtcaaacgagccgggttgacccgtttccggaccggttgaaacctggaccgccccggaccagtacatagggggccgggtgggtgggttactgggattaggggttggtctgttcacatttaatctatcgattacccggactggtcaaacccggtcaataattttttctatagaaccagttaaccggcccggaccggtttaacgactatctttcaatttttttaaagttgtttaggactgttggcaacggtcaattggcttttggccgttgcccaacggctggaattgcacaatagccctttcttgggcaaattttttttaaaaaataacacttttaataattactaatttagtcctttgaaaaattataattacaccctcctcttcttcatttcttcactcatctctcatttctcaaactcatattctctcattcaagttatatcatgccccgtgattctagagtgcgctcatatgtttgggaacactttgaggtggtaaaaaaaaatgaagaaatttacaaagtaaagtgcaagaactgtggtcgtattttaaatccttcatccaaaatgcacgggcacaggctatttaaggaggcatatgaagagttgtcttgagcgttctccagaaattcgtatttaagattttaagttgattacttgatttgagacaatttgtgttattttaatattattagacgtattatgcttaatgttttagtttgttagattaatttgaagtattattaatttattgtgcaatgataagtgcaagtttgaactttaatttaaagtattaaatgtaaactttaatttgcaagtttgaacttgcaaattgtaagtgcaattttttttccatcttcattgtattctattatcttaaaatttaaattcttaatgatatattcaaatataagaattttaaagtctttgcatcctttattcaaacactatttttataagattattttttgtttatatttttataatagttatacaaaatacaaaaataataataataataataataatttaaaaaaaataaattaacgctaacctggcgcagcccaaccctaccccttggacccgtaacctctacggtttattttttacccggatggacccggacccgttaagcttggtaaacccaaatcgtaaccggcccggttcggaacccggactaatccattttttccctacccagcccagccagccccacccgtttaacacccttaaattggaacggagggagtattccagcataagtatattggagttccagcaaaatatactggaactccagtatattatccagcaaaatataccggtccagcataatatgctggaagttcatatacaggtgctcgaatctccaatatattatgttgggacttttcgcgtgttggagttccagtataatatgctggaagttcatacacaggtgcatcgaactccaatatattatgctggaccgatctctgttacagcaaaatagtggctatttttcaaataacctgacaaacactgactatttttgaattatcaatccaaaaatttgctagcccgtactatttttacctttttgtttatactaatatagcccgtattcattaaaaacgaggaacaagtacacttagaatcactttgttgaaccacataacagaattggcccatattttaaatctttactcgcttagcctaacgtgtacatgatttaaaatgaaaattattggaagccacccaatttagttgtttggagcttctgctttgcattatgtgctatttttgtgtgaaaataatagttgattatgcgaaaaaattatttttttttaaaactttggcctattatctttgggctacatatttgtgaaaatataaatgtatcacctagttgcaatttatccgtatggatgtaagaaaattgaagaacagaaaattgaaaaatagaagtccgttattgacgaccagtcaaagctttgctttcgaaaatatatttttttgagtttgttaattgttttgattgggtgttgttaaaattgattgaaaatctcaagaggagttcaaaattaaaatgtgaaatgatttggagtagatttgagcaatatttgagttaaatttcagaaaaggcgcaagaaagaagacgaagtcagtttttgtataatgatgtacaacattgtataatagtgtatatgggtatataaatacctcttatagactcttatacacctttatacaaacgtctgtagacgaacttcttccacgttttttagttacaatttttgttcaaaaccattccaaatctccatcaagtgacgtcattttggtatacaacttccttatactatttctaataagtttaggacacccactccaaatttcttacaaaatcagattcgaaatttaagtaaacttatctaagcctgtccaacaatggtgggaccagtataaatatttattaaatgacttcaaattttgtatacaacctcctcatactatttctaacaagtctaaacaacaatcactccaaatttctaacaaaatcatatttgaaatttaaatccacttatttaagagtgttcgacaatgatggattatcttaaaaatctaatttttcaccacccaaatatatttggattgttgaactaatatttgaatcacaactacatattcgaacattagattaaaagcttgagcatttaaaaaaaaaagtttactgttttcttttataatttcaaatttctgtttcgttttttttttttgcatcctgccccatcccctgtccccctccccccctccctaaaaatttttttaatatattttcagttttacttttttcatctttcgctttacaggttcgaaattttacaaattccaaagttatggttcggaggtttatatgtttcgaaatttacgggtttagaaattataaagtttatgggttcgaaagtattgtcggttcagaagtttatgaaatttgtgggttcagaaggttgttggttcaaaagtttatggcttcatgtttattctatcaattatttatgaatactcttgagaaaatcttttccttaatttacgtaccaaatatcggaaaatgaataagattactacttgtttttcaagaaaacattttccacggaaaacattttccgttatatcaaacacaccaaaactctttggttctttttatcaaattttaaatgattttctctcgttaaaactttagtattgttgagaacatttcaatctctctagttataagccctctactttgagaagtgatctaacatttttgttgattgaagtatttgatactataatttttagttattttcgaacattcatgaacattctcgtaactattatttctatatgtttggtttacttaaataattaatacactagtactatttttctctccttttttttttttttttttttttgttctttttgttttaattttctgaaagaggctaatattattgtggttttgtagaattaagatacttccgttgcgaaaattaaggtattctttctacaattccaaaattagcgtatgattaaagagtttatgttctatctttcaaaacaagcatatttcatataaaataattatttctctctatatctttcaatactaataaatttattatgcagatgctaacaaatactctataaattttaatcaaaataagctacacaattctccatactcaaagctattaaatcttaattaaaatagaaaaaaatatcatcttggtagtaggaggtgtacatggacagggttggttcgagttttatcaaaactaaatcaattatatcggtttggattgatttggttttgtcggattttcggagtttttttgttatatgaatatgatttcaatgttgcttctttaaagttatagataaagttttgataagtgaatatatatttactaaaaattaaaaaaattaacaaacatataatctattaaagtatttttggagagacttctttaataacacatgataggttattttcttagtcgtctaacaatagtttttggttgattcacgctttcaaggttaaccaaatttagtaattaaacataaaatcaataggacacctaaataatgatatgttctatgtaattttagattatcggaataacacttcgaattcgaaaaagatataagaaaccttgaaatataaatatgaaagaacaaagagatgattgacgcatttcagtaacacttaataagaaagtgatataataataagaatgaatgcactgtaaattaaggacccgtttggccatagattttgccaaataaatttgggttttatttggcaaacacatgtttggccaaaaaccagttcaatagctggttttgggccaaaatatcactattttatttttcaaaaattgccccaccaaacttttgtattttataaaatagcccaccatttatttttttgtgacgatattgcttcatcttttcggtcatctgatagatatgtagttcattataaaaatgataattttgtaccaaatttatttatgttcaggattatgttttgcggtaatataatgaatattattgataatggtactgttgcgtatttgtgatagttttttgaacatgtgagtataagtcatgtttcatgtttttccaaaataaacttgagaaatatgttttgaaaactgatgtccaaacatattttcattttcaaaccaaacgtcacccaaatcagtttttcaaaacaaatttgaaaaatctgtaaccaaacgctagctaaatatttcactccaagagaaatctaaatatgagggatcaatatgcatttcgaacaaggggtaatagaaccccatttcccacaaagataacgttgtaaggggtaacacgagattttaacagtttttgtacgcgtcagaaactatttatgtttggtagttgaaaagtgtaaaaaatttgtatactttttgtatataatacacggaatatatatcatacaaaaaagatatatctttttttggttattattttaaaaatgacgactatacaatgtcatttttcctaaatttaataaaagtttgagggattagtatgtattaatcccaaaaagtaaatgtaattaattagcatcatgtgaaatctcttaagtgtaaacgctcttgtaaaccatgcaaaaaatttgaattcaaggcagcgccaaactctctctctaatcatcttcttcttcttcttcacctctctcacacagacacacacactctctgtcctaaaattcaaacattaatctctccaaaaaaaaccaacaatgtcttctatcagaccatcatctcggtatgctcataaaactggttttgattcacaacgatcttccaccaaatccgacccttcttcttctacagaactcacaccaaaaacccacaacaacaacaacaacgctctaatcaaaatcaagaacgcttcaaatggtgttactccaactactacccaccattccaatttcagctccatggttaagaaattcgttgaacacaaatcaacctcctctaaattgattaagcagaaaaagggtgatttgaaattggttatacctgcagattttatagctgaagatttgaagaaaacggcgaaaagaggcggtggtttgagtgctttgcataagaagttgtttaaaggttcttcttctagttctactggtgtgaagaaagaggagaagaaagcgttgactgaagtcaaagggaatacaggacattgggaatggtgcttagaagtgaaagggagctgttgagtatgaacaaggagcaagaggatcagattcttgagctcaaattaatgcttgaggagaaaaaccgagaggtacttaatctatttgtatatctgattttgctgcctaccgttgaattatcttaattcttggaggctaatttttctttttaaaaagttttatcaacagcttgggattgtttaaaagcgtgtcttttttgaattatttttggtaaattttagggcaagatgtaaactttttgcctatttcagtcaaagagattagtttcccaaatgtggattttcagaatattggatgtgtaatttagggcaacccagtggactagtcccgctctgcgcggggtcccggaaagggccggaccacaagattctatcgtatgcagccttaccctacatttcttcgagagattgtttccacggttcattggaggtgtaatttgaaatcataaaatgccccttttagaagtacttgtgttgtaaagtggtaaacaatgtctttggtgttagaggtttataatattgtgcaagatggcatatttactgttgcaaaataggggataatattacttttgatggcacattggttgattatcaattagttggaattattccttgttactaactgaatatacgcgtatgttacttaagttgatgcttgaagagaaaaagagagaggtgctatatttgtatatcatatagtttaatcttgcattctatcatagttcttgaaatttgaaccttttttcttctgtagcataaatttttataagggaagttttctatttgcatcttaataattggagggtaactttgaatggaatgtttgaccaacagcttgttctttaatttgttcaaaagtgtctgtttttaattatttgggagtacattttagagcaaggtgcaaaatttgtctattttattcaaaaagtttatcttttgatatgtggattttcaaggatagtagaggtgtaaatttgcgcgggaacttctttttgaagatgacacatttgttgttgtaaaatgtgtctggtgttggtggttgataatcgaaaagaataatgtaattatcttgttcgagatgccacatttattgttcctccctgcagtttgcagcatgaatcaattaatcttttgaggttatgttacctctttgcttagttttatgatttgctcacaatactgacaggttgagaagcttaaggatttgtgcttaaagcaaagagaagagataaagtcattgaaaagtgccgtgctgttcccggatgttatgaattctcaacttcaggatattttggagaagcagggttcagaacttatacaggcaaagcagcttataccaaatcttcaaagacaggtcacttctcttacaggccaactacaatgtctagccgaagatcttgctgaggtaacaatataagtcattatcgcgtgctatcagcttcatatgaatcgtttaggactccttgttggatctttctattctttaaaccacaaaattccaatgtatattgtatttaaaaagcttcaccattactgatgacaaacaaaaactagttaaactcagtcaagttttctgttaatatcattagccttactaatcttcaacatgaaatgcaattgcaccaaactagaatttgcagttttacttcaaagattcaaaatatctactgctaaagagaatctgcttgatcgaacgctccacgagctcttaaatatgtcttgaaggatatttcaaaagagaaatgattttctacctcaataataaaccacaaaggcccctgacatgaaaaatcagtattgtttttggttgctgcttgctccatcagaaactcagtagttaaaatactggtcaagatgaaaatacagaagaatcctaaacggatctagttgatatatactttttcaatattttcacttttgcaagttgaaagtcaaactatcacttctatgtttcttataaatgatttggagggagctatatgttgggatcttgcatcattcgttacttatatagcatatgcgaataaattgtttaacggggttttttgctcttccactctgtaagatgaaaaacaaaggtaaggagtgccattagcttgctttttggtttctcatgtcatcaagtaatatggtttgtagcgtagtttaccttcttttttggtaactaaacaattttatttaccaagtaatatttacgcatttgattctctttatagcttgatctggacaatagtcccagattcagttatcccttcctttcccgctactcctacttattcataactacctttttacatatctatatgaacagtaggatagtagtttaactctaggaaccttctattaaatcgttgcttcaaattccctcggcaatgtatttcctgcattaacaatcgagtgattgtttcagcattcctctgtgttgcttgaaagattcgtgcattcttctcttgccatatatagtatatgcttccagctagtgtcatcctgtaaatttcagcgttggagctactacctttacagcgtagtttaccttctgataggcgcaaaacactctttcgcttcttttaattactctgctctgttgctaccacaatattgaaaagtctgttgatttggcacccaagtgctttggatgtaataatgcaaatgtctttggtttatcataagaccagcattggattgtttgagaaagtggctaatactataattttcacaggtcaaagctgataaatatgctataagagggagctatgattctcttggtagccctccaggatatgatcaagaagaagcagctaattctctggtaaaaacatctgaataatgtgcaaaggtttcaaatgcaacacgaagtttgttgtgaacaaattacctatatagcttagacatgaatgtgcatgttggacattcgcatcaggtggcgtaatttggtttctttgtttcttttaggaattcagctctgaggatcacacaattcccggcagtccagatgacatgtttctcaaggatgtaaacccctgcttaacaccttattacgccaagacaaagtccaaggtgagtgtctcattggtgcattcgttgtgtaaagttccaaagtttgtcagtgacagcccttcttgtgggggcaatcctgaatttgctattgctttgaaatatcttcttgatacatagtgttatttctcttataaataaagcgactcgtgttacagttacttaacatgttatgttttaggaatttgagaacttcaattctcctgatactaaagatctggtaaagaccaatattcaagtttatcatgagaccagctacagttcttgtgcaaggaagttgtcgaaaagttcagactgtcgccaacattccaacacaacaacccgtgcagctcgcagatctgatgaaagcaaatgcacatatggaaagcaggtccacagtaggttcttctaagttgtcctcaatcctgaagatgtttcttgaggagcagtaaaccttaagtccaacagctcggctgagaacaacattcgtgtgaatgcatagttgtttcgaaatcaattcctattcccttctctccttttcaatatactatcgaaatcaatctgcgtttcgacttctttttgagatgtagaccaagtatctggttcagtatacattttgttggtatttcataagatatgctggctaattccaatagtccattgaatctgagtagtcattcatggttatgttttataaaactcttgtgatgaactgcatgattcgttaataagatgataatatcatacaatgcacatgtatttcaacaaagatcaagctcatgaaataatcatggggcgataaggatgcaatttcaatcttgtatttcattaaatctgggtaagaatatcatataagtgattccacactactatatttgtctgttttggatgatcgatgagatgatgaagaattaacctaaatagccgtccatccaattgcttaaactaaaatagccagtaaatgtataatatatgcataattatgtattatatgtgtatatttatgtgtattcaatgtataatttatgtatataactagaaaaggtaatcaataatatgaccgactatttgcataaagataccttttgccttatttttttcctttagtcctacaatggatatcaggctatatgacctctctttaaaattttcccatggaaatcagtagcttgtgtaatgaggtaaggaaaatttcttttcttgagactagtgaaaatacatactccctccgttccagtttatgtgaacctatttcctttttgatccgtttcaaaaaggattacccctttctaaatttagaaacaattttgcttaaacttacaattacccttgatgagaagcttttgtaaccacacaaatgttgtaggctcctttttgacttgtttaggaccacaaattccaaaagtctttattttttcttaacttcgtgcctagtcaaacaagttcatataaattagaacggagggattaacattttaaatttaatagcctaatacattttttttgtcaacaagagtaacaagtacgtctggaggtccaaaatgattttatttatatgtgtgtgtgcgagcgtgtgcgagcgtgcgcgaacttttcaaattgttactgaggtccaaattcaaatggttaaaattagtggcataggtgggttggctcgaattttctaattaccaattattaaatctaaataccaatcaaacaaataaaagtcgggtttttaatctcggtttttcgggttttcggattttttcggtttttttttttcataaagtcttcatagcataaaacgtgaatttgttctccaaatatttctttaatcctagcaagacaaattctataaggcatttttcataaaataacataaatatgagatgagtcatgacattgtactaaaatattcaacaacaaagataataaaattataaaataatattattaataaggcataataaaaacaaacataatttaaaattacgactaatacgtactaggagtattatttacatgactaaccattaaaagaaaaataagttatacattttatctaaaccataaaaaataaaaataaatatccaacactattttcactcataatacaattgaattgaatgtttttattagcattagtattgatttgattttggcttaggatttatttgagttactacattaaacttatcggagcatccaaaaattataagctcaagcttgaaataatacgttaaaagataaattacgaaaaagcttaagaaatacttataaactacactacaataaatatttttatgtattaaatatatttaaaatttctataaataatgtcgggttggtttttgttcgatttgactttttttagttaaaaccaaaccaaatatggacggattttttttccaataccaaaccaaaccatagtcagatttttttttcggtttgactcgaattattgagttgatgcgatttgtctgtttcatttatacacccctagttaaataagatgcaactttgttgggggtgggggaggggggggtgaaacttaagaaagagtagagagaaggaaaagaaatttaaaggtagtaaccaagtaaagagaatttttatcacaaacttatttatagtttggtttataactatttattctaaaaagatttctccattgcttaaagtttcagttttgtggagaaattaaaagcttccatattcatagtgtcccaccattatcgccatcttcacaacctggaaaaactgcacatccaaaaagaaaaaaaagatttattgcatcattttgaaaaagataataatgaaataaatttagattatactaaaataaagagctaattgcagcttttaaaacaaaatctacattggctgttgactggttttgtcaaaaatagggaaaaaggttaaatttatccctatattttggatagttagttacgtttatatccgttttttattttccgtctaaaattgtccgcaccgttaacaaagtagataaatcacccaaaccctaatggatttccaacgtggcaatgggacatttcacttaaactgccaactgggcaattatcgacccaaattttaaaggcccgtgcccatttcttttacccaaagactcgtgcccattaatggctagtgactatctctcctttttcttaaaacccataagttatagccgtttgaccaagcttctcgggaggtcaaaagtgatttttttttcaaaaatatatgttttttaacttgagttatttggcgcaaggttttttgggggggggggggggggaagggggggaagcacttttgagaagaagcagaagcagtttttgaaaagcagaaaaaatagcttctttccaaaagaagaagctgaagcagtttgacttttattcttatctaaaatacccttaacaaaatataatatataccaaaatagccattcaacttaatacttaggatattaatgtataagtatttcttcttatttataggaataacttcaaatatatagtgattttaggagtgaatgcttttatatttgttgaatgaatttttatatttaacttacattaaaagaattaagtacttttaaattttattttcatattttacttaaataaaataaaaaaatttaattattgcatgtaataataaatatttgagattatttatttacttataatataaactattaagtaaatttattcttgtctttattctaatttgatacttaaaaaaaatactttctgaaaagcttggccaaacataaattattgctcaaaagtacttttcagagtgattagccaaacacaaactacttctctccaaaagtgcatttttcaaaagcacttattaaaataagctgatttatctagcttggccaagctgactgttagactatggaaattttagctcaacattgctaagtgaaaaataataaaaaagagaaagtgaaaaagaaaagaggataaggttggggaagaagaagaagacacaaccagaataaatgggcacgggccttttaaaatttgggctgataattgcccaattgacaatttaagtgaggggtcccattgccacgttagaaatcgttagggttgaaggtgattttatctactttgttaacgttgaggacaattttaaacgaaaagtgaaagcaggtataaacgtgattaattatccaaaatatatggacaaatttgaccttttttcctcaaaaataagtatcagttcttctatgactcaaactatagtgtacattatctgtagtagcgtagtgctgaagctagaaatttaaactgaggagatgtcaaaatataaaaaaaattaaacacaaaagtataaatgaagggagtcaacatatcatatatatataatatataaataaattttaattaactaaaatagtgtagtttttcgacgaaggatatcaattaataccctctaacataaggtgactccgtcactgatagcgcatgtatatccactgccaagaagcacatatatactactaacatttaaattcatcatcatagaagcagaggcagagctagggtagtggaaagcggttcgtccgaattctctttgctgagtaattacattgtacatatgagattagaattatttttcatgcataaatagtagatgataatcccctcggcatgttcgtgtgtatatatatatataatatatatataggattagggaagcttacaagatccaatgaccaaaacagcaaagagagcaagaacaatgtgagctggttccattttgttttttcctgttagaggattcaatcctcttcttgtgatgttcttctcaaacttagctattttcctctctgcaactcttttggatgtagtctggcaaattttgaaaaaaaaaagaaaatcattattatcaatttctttaaaaacattaaaaggaaaaaaaaatcaaaagaaaagaaaattatattacccaaaacttaatattaattttgttctaaatttttttagattaattgcaaaatgtttgaaaaaaatatccacctccagtatgtgtatagaaacataaatgcatttatgacaaataaaacaaaaacaaatagactttggagaaaatatggtcaacttacgttgtcgggttctcaaaagctccgataaaaaataaatcaaagtataaggctaaatcaagtaattttatttcattttaacaagcaaaacaattaagtttgtgataaggataatcatcattaaattttgttaacaacaagaatagattaaaaaaacaaaagtgaaacgaaaagagagtaattactacaaatccatggctcttattggttttcttattaaggcgatatttaaacgtttgcaaaaatatctttttaaaaaggtcgtgttagggtgctaacgtctccattatttcaccaagtacttactatttttcaaatagtttgacggccaacggtcaaatcatgatgaaccctttaaataatacaaataattcacacaactaaatctaattaatttgaaattgagacgtagttagttcgatatactcctatcatattcctcgacgttaaaaaacttgcaacaaataggagaatagaatcaaacaaaaaattctatggaaaaaaaattcttccaagcaccaaactttgcagtaatctacgatttcaaaatgaaactcaagagaaaaatgtattaaataattttcaaaagataaaatcgccaaaataataatttctgcttgatcatattcctagaagatactttcgagaaagaacaaacacgtctcaagtggatatacatacaaatctataggatcaaagaggacatcaacatagacaaggagaaaaggaagagaaaaaaaagagaaggatgtttttaccattttttcttgtgtgtttgttgctttgcttcaatggtgtgaagtaaaaaaaacgaagaaattaacttggaggctgtctgtgaaaaagttgtaagaatcagagaaaacctaagatttgtctgtgaaaagaaaattttcttttttgtgcgttatcttttttagaaatcaaccatttcaaagaggaaaaatattcaatgtttttctactctaattaatttgggtattgcattaattgcttcttgctttaatagccaatttagcttatatgacaggtgttaattttctcttcttttttaattaaaaaaaaaaaacaaatacaatgggtcgagatactgccagtatcagttaagaatattcattcaaccaaaactaatataaatattttcttttttttggagaagaatataaatattttcgtaacatctatgatgtacaatatattattatggtgagattaattaatcgtttcttcgaaaacatcagaaaaaatcgaaacaatataatatcactacctagtcccatatcgtgtttctcgaaattaagcatccatctccgaaaaatatattttccccttaaaattaaatagttatagtatgttctttcatcttgtgaattatttttcgtctcacgtacgaaagagagtttagaaggcaatcttttaatagagagggaaagacagaggacaaccgattatgaagatgcaatggtattgcacagataagaatgagttagcaacgttcgaataagttactcgaccgactaaagttaaaaggagaaagggagatgactctaattattgaatacaattgatcgatttctagctatagcaaatctcactcacttatactagaacgctttctcttattctgttctttgctctgcggaatgccctgtttaatctaaatcatctcgtttggttttaaagtcaattattgaaatgttaaacaaaggttattagattattaagaaactatttcaattaagaatggatatcaattagtaccagcataacaattaccaccactaccaactatcactactagccaccatcttacaacatattttgtggatatataatattttaattaatttattgaataatatatctttttaaatattataatataaatagattttaaataaatatcatatatacattttaatcattaaaagaagaaacaaatggccccttcttcactcataactttaaaaacctacaatttcactaaaatttcccaccactatgcaaataaatagctgaatatacctcatgtgtttataataacaattcataaaacctacgaaaccgatgcaaagtaaattaacaaatgagtgattcctaaatatacaaactacaaaaaaaactagaattagttatgaacgccgtcgttaatctgtcgctaaaatactcgtaactgacagaatttttaataatttattattaatttgtcactaattgagatcaaagacgaatttttctatttaattatagaatttgtctgtagctaaaaattgaatttttccgtagtgaacacatcgtgagaaatctagctcgtaactaccttgagacctaatccctttaattccagaattctgtatctacccattaatgtgaaagatgtctactttatggtaaaaaataaatatctatcgataagtaatgaaatctcatctccaagcaagtgaaatgcttacgccactttagagttatgagtgagcaaaacattcgttctactattttgtgatctttagttaacataacgaggaaaaggttttataattttataaaatatcttaactattttctaaaatcgagtattggatcgatacaatttcaacaaaaattcaaatacattactagaaaactgtcaaaaatcgttcaagaaaatcgagcgacatcagtcggaaatataggaaaaccgattgatgttcgaccaattttaattcgtcaaaaaaaaaaaacagtgctcgctaacgtgtgacaaccgaagatagtagcaatttccgaccgaaaaaacacactaatagaaaactgccaaaaatcgtcaacaaaaatcgagcgaaatcgatcgaaaacataggaaaaccgattgagtttagaccaattttaattcgtcaaaaaacagtgctcgttaacgtgtggaaccgaagacggtagccatttccgaccgaagtcggtcggttaattcaaccaaagttgaccactttatctgacaatttttattggaaaaataaatatactgaccgaaatcaattagtaatatgtaaattatttttatttattttttaaaatagcgaccaatttcgattgaaaatataattatttgataatatttacatttctttttaaattttaacataccgactgaaactggtcggaaatattaaaaaataaattaaaaaaaggttatttccgaccgacttcggtcggtaatttcaaatttttgcagattgcacattgaaattaccgaccgacgttggtcggaaattatgaatttctagacttttaatatgagcattaagaccgaaatcgatcggaagtcgtcgattttccgggtaaaaacctggcagaatatgacttctttttaagctacaccacatgccaattacaaccaataaccatcctctaatgacaatattatattgcctccattcaaccacaattaaccaacaacaaccatgattaatcaacaacaataataattaaccaatgcctactgtattggtcaaaattaggcaaagctcaatgactgcaaatggataagacatggtcaaggttgaagccaaccacggctcggggcgaggagtcgccaagagaaagaccagtgtcgaggtcgtatagagaacgaataatagtaatggataaaataagtcttagaatagtgagaaggaatattccattaaatattcctttaattgtacgttttagaggtttctagtaatatcccctataaataggaagagataaggaacaaaaaggggtccttacttttctgataagaacacattgtaaagggttgactatcaagaatatacaaaaagtttgtcttgtctattgattccgctgctcaatatacctcttttattcacaagatccaaggattccttatccatcttcatattctattgacacacgttattgtcggaaggaggaatcatccaaatcatctaacatttgggtgacaaattctttcttattacatttgatgccattatccacatttagtgcatattttcatcgttacattcattgacaatcaattaacatttactttgcattcattaatactagacacgatcctatctcatcagtatattcaaacttaagatcaaggagttattacgtttaactaggattcatccactattttctcattaatcagttcaacaaaatgatttaaaactttttggtcaaataatttggcgccgtatgtgggaggttctagttaagattttagtttcttctagatctaaaaaaataaataacaacaatagagaagacgaggagaacgtgacgccgagcgcctcacctaggctaagtgactcacctccccctcatgggagtgtaaccgtttcgcatgagaagggggcctctacgtccacaacagaggaagtgccgccagcagtgaaaaaactactggaggcgtggttgacaagcactctaaacaacatacttgacaaaccgctcaggggcgagtaagagcaccacacgagctgacaccacaacaaccatcaatgagcaacacgcttctcccccgacaggccacactcacaccattgttgatgcaggtaacgacgcgctcgcagccattctaaagaaaatggaagaaatggagaacgagaataaagctcttcgcgaccaaatgagggagcaccaaaaaagggttgataagatatcgggcgcctcgaaaattctaccaaaatgggacgtcggccggttcgtggaacagccgtacagcgaggaggcagccccacatgccatacgcaaaaccttcaaaatgccaccatatttaaaattatatgatggcacaacagacccgaagaccatatcattcactacgtcacggcggtaaaaggcaacgacctctcaaaagagcaagtgccatcattgctgctaagaagttcgacgaaaccctaacagggggagccttaacatggtactcacaattaccagcacgttcaatagcgacattcgaggaaatagtcgacaagtttgtcaccgcccatgccggggtcaagaaagcagaagccagggtgaatgacatattcgccattagacaatcgcctggcgaaagactcggggacttcctcacccggttcaatagagtatgaatgagccttccaaacgtacagagggatggcggtagcagccttccaaaatgggttagacaggaacgggtcgagggcgaccagaaagttgttaagcagactcatgatatatcctcccaccacctgggaagaaatcaaacacctgctgtgcctaggtgagagcagacaagacgacctcaacgttccaactaaatggttaacatcagtccaaatggaatcaaggaaagaccgccgtaatgacaaccgaagcgatcatgtagatccacgcctcaaccgagaaaggagccaaccgtatgtcagaccggtcatcccgccacctcctggccaaaccgaagggccgtccaggccacagacggggactcactgaaacgaatgaggtatgcctccgcttttatctgctcacaatttttgtgtttccccatcagaaatagtgtacgccctagagaagctcggccccaaggtgaaatggccacaatagatgaagtcctacccaaattcgagaaagtcgaatgccctttgagttccatcaggaacggggccataagaccggggattgcatagccctacggcaagaagtagtgaacatgctccaccaaggacatttaagggacctgatgagcgaccggggaagagccaattttgcccgtggacgagaacaacatcaaggccccccaaagccaccctcccccgcccctaccatccaaatgatcatcggcggaggtgacgaagtaacaatcaaccatgtgaagttcaccactacacacaaactgaagcagttgatcacccatgaacgatatgatgacctcgaagacagtatcatcttcgataagtcatatacccatggtttgacctttcctcacttcgacactcttgtcattactttacgaatttcatataccgatgtaaaaagaatcatggttgacgatgggagcgacgcgtgtattatccaccccgtgttctcacacaaatgagactcgagacaaaatagtaccacgtttcataacactaacaagttttaacaatgtagttgaacgaacctccggagagaacattgcccgttctggccggggcgtcacccttgaaacaacattccatgtcatgaaccaagacacagcctacaacgccattatagggcgaccgtgatacacgccatgagggccatctcgtccagcttatatcaggtcattaagttttcgtaccccatggggaacaacatctgcggtgaacagcgcacagctcaagaatgctaccacatcacccaagattgtacatacactcaacagttaaaaggggagggctcaagagcatagcaattaccgaagtcggggcccgagctcgacgaacaaaaatgcgtcatcaaagaccccgacgtcgtaagagccacatggtcaacaatagaataccttgaccctgttcaactggatagcaccgaccataacaaaaaagcttacatcagccataaactcacggaatcaggtaaattccataattttttaactgacaacgctggtctgtttgctttctccaatgcagatatgccaggtatcccgaaagacattgctacacacaagatgaacgtcgatccactctacccggcggtacggcaaatcaaaagaaagttcaacgctgcaatcaacgatgtcgttcgcgaataggtggaaaattttctcgtcaacggttccattcgagagtcaatgtacccccaatggatcgccaacgtgatcatggtaaaaaaaaaagaggaaatggcgcatgtgcgtggatttcccagacctaaacaaagcctgcccgtaaaactcctttccgttgcctcatatcgatcaactcatcaacgcaacagctgggcacaatttattaagtttcttggacgcctactcaggctacaaccaaatcctcatggaggaggaggaccaggaaaagaccactttcatcaccccaccaaggaacatactgctacagagtcatgtcgttcgggttgaagaatgcagggaatacttatcagaggttggtcaccaagatgttcaaatagcaactcggtaaaataatggaagtctatatagatgatatgttggttaaatcaaaaataaaagaagaccacatcgactacctgaggaaagccttcaatatacttaggcgatacggtatgaagctgaaccccaaaagttcctctgggaagttcctcggtgttttggtattgcagagaggcatgaggtcaatcttaccaaatcaaggccatagagggaatacctgaattttgaccagcaataaacaggtacagaagctgaccggccgtatagccgccctgtcaatgtttttctcgcgatcctccgacagatgccacaaattcttcaacgtactcaaaaaggacaacggactctggtggaattccgagtgcatcgaggccctaagagaattaaaaagcatacttgtcctctcccccgctgctcgccaaggcagagcctgacgagcatttcttaatctaccttaccgtatccgatgacgcagtaagtgcagtcttggtccataaaaatataaggtacacaatctccaatctattacattagcaaatccctggtcgatgccgaaatgaggtcccccacctcgaaaagctggccatggcattggtcgtagcttcacgaaaacttagatcatattttcaatgaaatcccatctcggtggtcacgaccttcccctaagaagcatcctacataagaccgagatgtcagggagattggccaagtgggccatcgaattaagcgagcacagatataacatatcagccgcgaacaacgataaagtcgcaagtactcgccggcttcgttgccgacttcagcgccaaaataatgcctgaggtcgagtaggaagcctcccgtacctctcccaagttaccacacctatggctcctgtacaccgatggcacctccaacgcgtcaggatctggactaggactcgtactcgaggtcccaacaggctaagtcatcttccagtccatacggtgtcctgatatgactaacaacgaggccaagtattaggccgtaattgtaggacgagactagctcgcaagtacggagcacggcgagtcatcctccgatgtgactcacaactcgtcgtcaactaagtcatagggactttccaaatcaaagaacagaggttacaaaaataagctattacccgagttcgatgaaagtcaactcgaccagatacctcgagcacagaacatcgagatatacggcctcgccaaattagcagcagccaccaagaacaaaagcggaaaggaaacgtggtcacccttcttcattcgtcaatagaccaaattgaggtacggcactataaacttaacttgggactggcgcaaccgtattatgtcatatttgcctgaaggagtactcccaacaggcaaaaaagaagccaagaagcttcgaatgcaggcaaccagatatagcatcatcaaccacgacttgtacaacaacatgtttggccgccccttggcgaaatgcctagggccaaagcaaaccaggtgtgtcctcgaagaagtacgcgaaggcctctgtggagcccataccggaaatcgagcctcgtcagataccttataggagcaggctattactggcccaccatgaaaaaggaagccgccgactttgtcagaaagtgtgagcagtgccagaaatacactccaatgattcaccaagcggtcaagcacctccactcaatcacatcgccgcggccgttcatcaaatgaggaatggatatcgtcggaccccttccaacgggacgaggtaatgtacgattttttttagttttaactaactatttctctaagtgggtagaagcaggtgcattcgcccaaatatgcgaacaagaagttatcacattcatatggaagaatatcacatgccacttcggcatccccaaagaaatcagttgtgacaacggaccccagttcaccgaaaaaaagaccgtcgaattcttcgagaaatggcacatcaagaaaatactctccacgccataccatcctgcaggcaatagtcaagtggaatcctccaacaaaacaatactgaacatcataaataagaatcttaaggatgcgaagggactgtggccggaaactactaccaaaagtgctatgggcatattgtaccacaccaaaaaacaagcacaagagaaatgacatattcactagtctatgggactgtcgcagtgatacctgtcgaagtcggagaaccaagtttgagatactctaatgagagtggaccaagtaatgacgagaatagaaagtaaacctcaacgaaacagatgagcgaagagacatggcctacataagaatgatagctcaaaaatagcaaggtactacaacaaaaaggccaaagtcaggccactcaaggtcggggactacgttctcaaagccaaaacacaagcgagcaaagacccacaggaaggtaaattaggaaccaattgggatgagccatacaaaatcacgcagcatcaaacaaaggttcattccaactagaaacaatggagggaaagctactaccaaacaattggaacgtcgcccacctcaaatacttcagcttctaaagacggacgtcctccaagtcgtactctttttctctcaccgagttttgtcccaattggcttttatcggtgaggtttttaatgaggcgacgaagagggcgtctcgaagttttggtgctaaattcactgccccgcctatcgactacttctccaggccgagcgttgaagggactagatagactaggacttctcaaatgtatgtacgggccaaacagaaacatgtaatattctccaatgaatgaataaacaaagcagtatgcgatattcttacacaactccaccgaatttgcacaatagaccaacgcagagaatatacattcgacctcactcgaatcaacttatattcgaccttgctcgaatcaactaacattcacctcaatccaatcatcttatattcgacctcgttcgaatcgatctacattcgatttcgtccaaatcaactttacatccaatcgaccgaaagtcggggacttactcacaaaaaaagataccaagggaaaaagaaaagaaaagctgaaaatacatagcagaagacagttgttccattccaatcgttccgttccattacattttacaaagagcttcagaaacgccccccaacaaaaagaaagcagcaaaatacaaaaaaccaaaaccaagtacaaaggcttcacgccacaccgtcccccatcaccaacatcaccgacatactcatcatcgtacaaaaggtcagaggtgagcccatccaaggcatcttcattatcgccccgcgggcgtaccgaggtcgtaatcgtaggcgtcacgagctacatgtgccttgacacgaacatcctcaaattctgcctcgaaaaactttccatccgcctttaaagacctatatatgtcaagttgggccttagcgtgaacccacatctcatacaactcccgtgacacactgggatcagcagaagtacgggaagtagatggttgggcatgttggttctccttctcggcccttagggcggcaacttgctcatttatctcagacagctccgcctctaatccctcgatccgctcttctaacctcgcctccttgagcgccgaagtctctgcctcactagctcgctcaaacctacaaacacgtaaggtaccctctaaggctgctgcctccgccatggcggccatccgggttttcttagctaggcttagctcttcgaccctagcgcttaactcaccgctcaagtcgacggccctagcctcactttgctcaagctcaacctttaaggatgccacctgcgcctgaaggtccgcattctcaaccatcacccccttactcacctcgacctcatcctctttggacctcagcttcccctccaacacgctacatcagccgatggccctcataatctccttatctttctccttcagctcctcgtccctctgcttgatctcatcatgaagcaactgaaattggccgtactcgccaaatacgttgaccagcgttcggtgattcgcgcagtactctctatacttagactccatcttcttgaagagggccgtcctccgctcctcccgccggtcacgctcaatctccaagatgagagtctaacatacaaaagaagataggtcagcagaagtaaacaacacatatgaattaaacaaacttaacacgggagaagtaaaactcgcccgcaaggccatgcctgatataccccatgacagatcagcatctctcaacgtctgcaacgtcctattctcggagtctgtgcacaatggagcaaaggtcggcaccgcctgttctgagttgaccaagaggttataatctacagtgatgtctatatgccgatcaagcccctccgtccttagctccacccgagtaaacctctcctcaaaagaccgtacctcctcaaggtcaaatatcagagccagacccttcgtcttccacgaggacgactctatctcgcctgcccaatgatgagcaaacctcgacagtccatttaggcttccctatcacagacccgtcaacctcggacgacctctcctctatgacgttatatggcgcgggagcgcctcgatgttcagcaaaggcgccaactccgcattcaggtctataggcccctccggtgcagcaccagatacagtagcctttccagtctccaccattcgtctcttcctcggtgcctcatcctcatcatcgtgagatgactcgtcaattaggtgcaatatgggctgagaagagtctcatccggtgtaataatagcctgaggggcagaatcacccaacgacagagcttgagtctgatcccctcgtactaacttagccagtcaaattgcattccagccgaagcgacttcttggcggaaagcgagcaccgaagccttcgccttcttggaagctcgccgacctagcacaaaagaaagtcacgttaaaagatggcgacgaacggtgacaagttataaagtaataatcagactcactaggcgagggcttgggcccaaaccgcctgtgaaaggacgcccagtcgcggatttccacagtatgtggtaaaacgcgagttacccaatctttaatgccgaaaatcagggaaggtggacacctctcaactgaaagtagaaagccagagcgagtctagaacaaaaaaaaagagaaaaagggagaataagcaatatatggcaagtgataaaagacccttacaattgaagttccattgctcagggaacacgattagatctgccactaagtgctcggttctgatgaagaagtatctacactaaaaccgacggttcgcattgtcatccatcccggccaccaatcttttagtccccatgatgccagagatgaatgggcgtgcctctataaaaattgggtgatagagacctcgcagccggccaactctgtgaacttcgccagcatcagaaaaaccttatacaagtatggggagagctgtgccgggcagacgctgtagaaacgacagaactcctcagctaataggggtacaggaagagaatagcccatcaagaatgggtaggcgtagaaagcgcaatacccaggctggtggatttgtatcacgttgttccccgctgaaacaatatcgacgtgcagagggatatggaatttaaaccggagggcggatatttgactccaccccatttcagagagtacctgggcaggagcaaaggtgggttctttagggaagtcattcctgaccgacgcgaggaaccatctcctccacggtggaaaaattttcatcttcctcaaccgtgggctcaccgccgccggaaggtattgccaccgacaatggggtggcattggagaccaaatcagaaggaggagagtttgacattttagcagcagcgtgtacagtggagtcggaaaaagaaagtatcgacgagagaaataatcggaagttgaaactaaaagagcagaagaaaatcggagacagagattagagaagaagctgaagaataggcaaagtgtagatggaatatgaaatgctaaaagtctcgattgtgaagtccccctcctctatttattgggtatagtggcgcctaaatcaaggcaagggaccgtcagtgacaccataatcgaagcaacataggcataggaaacgacgtattgcattgggaagacgtgtaacggtgacgtgcgtggccatgacatcatcctatgtcagtcaatccaaccacggcccttgaggcgactgacactagttcaacctcgaccaatttggctcaatcaccacgactgaatctcttttgaccggtcgcaaacagaatccgctcatcgagaacatccaagaggatgacctcaacaagaggagggactaactgaattagtcaaaattaggctgagctcaatgactgcaaatggataagacatggtcgaggttgaagccaaccacaagtcggtagcgagaagtcgccaagagaaaaaccagtgccgaggttgtgtagagaatgaataatagtaacggctaaaataagtcttagaatagtgagaaggaatattccattgaatattcctttaattgtatgttttaggatttttaggaatatcccctataaataggaagagataagaaacaaaaaaggatcttcacttttctgataagaacacattgtaaagagttgactatcaagaatatacaaaaagtttatcttgtctactgattccgctgctcaatatacctcttttattcacaagatccaaggattccttgtccatcttcatattctattgacacacgttattgtcagaaggaggaatcatccaagtcatctaacatttaggtgacaaattctttcttattacatttgatgctattatccacatttattgcatattttcatcgttacattctttgacaatcattgaacatttacgttgcattcattaatactagtcacggtcccatctcatcagtatattcaaacttaagatctaggaattattacgtttaactaggattcatccactattttctcattaatcagtttaacaaaaaaatctaaaactttttagtcaaacacctaccacaacaatgctaaaaaaatgtaattttaagggagaacaaatgcctgcaaatggtttagaagattttcaaaagtaggtcgcctattgttcaagcgacctactgaactcggcccattttaatcggtccaaaactatcggcccattgcgcccatttgacgctcctaccttttaactaatgcaagccacaaacacgaagataaattagctattacgtaaataaaaggaaatagagttttttttttcccaaaagacttgaaccatgtggcttttgtaagattttaagaatttatttagtcaccatttccgttgtaccataaaaaaattgcatcatttatgttttaatcacattcctgatttctttagtttcatagaaagtacaaaagtaagcagcaaacaaaatttggataggtcaagcaaacataaaatggttataatttaaccaactttggtcttgatttattttacaacagtccataaaaagatttttttttttaaaaaaaaaaggccaagggaaattcaccaaactgaagagtaatcaatatcttacatttcctttcctttactattatttccatacaaacggaagagactgaaagctgaaatgccagagagtactatcatactaaggctcacaattagagaacttgcaatgccttctccaacttggttacagaatttgccatacatatcgcaaattttcatccattgtaactctgtttgccctaacttggcaaataccgccgactgtgcggccgcggccaccgcggctagtgtcaagtaggccatcaactgcacatgaaggaaatattagtggttagaggcggattcaagaattaacgttgataaattcgactttttttagaggttcttatatagttaatattctgttgaaaatttagtgattttttgtatatatatctatgtgtcatgtcagaaatgaatggtcctttatcagagatgtaacttgtaaacatggtaattctgaactaagatgtagtttaaatttagcatgttagtgtgaaactaatgaagttgttggtttaagaggtggagccaagatttgaaccttatgggttcgggatgataattctttattgggttgtaaattaataagttgtacatatttaatgaatttcttaagacaaatacatagtttgaacaaaagctactgaattcggtcgaacccacattcatactctgcctccgcccccggagggttttgagcgtttttgacattgaacattatattatcattgatagaaaggacaataggatatatgaagttgtggaattaagcaccataagtccatgggagcctttaagcaattaccttctaaaagagcaagccaaaaggtcaaaaaatcacttattaccggagggagtactgactagttgattttggacaaaaaaaagtcaaaaattacttattttggaccggagagagtactgactagttgattttggacaaaaaaaaaaaatcaaaaaatcattattttggaccggagggaatactgactagttaaatttggaccaaaactgtcttttttaaaaaatgattagactggtcatagattatgctaggattctctcttcatttatttggggggtttatgagttatgagctactcactgtctatgactttaatggtaccccacacctatcttcatcgaaaattatactgtatatacagataaagtcttggtgaaattactgacttcgtgccactgtcagcaagcaaagccaactcaggtcagaggacacctcaactaaagtttatgtctgtttgatagtttttgcagtataacttaccctttttttctcagtaactttgaattctttttctaagtttttggaaatcttgaaaaataccttttaggaggtttcagagataatgcaagaaatcatttatagataatcactcacaaaatctcaaaagataaactaagtaggattaacttgtacctgatcaccagaaaaaatagcccaagccaatggtttattaaagagaacacttcctctaaccatactcaaaatgcaccttagaacttgtaccaatgagtaggcagcagctaaaccattggctatcactaaaaacctgcagaaatagacacaaacttaacatttttagcctttggggactcaaaatctttgaaataaaagccaaataaacaccatgcaatcaagcgaaagaaaaaaagaaaaaaagacagcgcataaaatataccatgaacaaagtatcttgtatttacgcagaggtcgagagaatctagagtcgagagaatttagggaagggccgtacaccaaggtgtgatataagcagcctatgtggctatttctatgactcgaaccgtgacatgaccaagagaatccagggaaggccacactcagggtttgatattgacatgggcatgggccgagagaatttagggaaggactgtacccaagggtggtgtgatataaccaacctatgggctcgttcccacggctcgaattgtgaagaaggcgagagagttcaggaagaaccgcacctcaagggtaacaaagataacaacctatgtgactgcttccatggctcgacttgaaccgtgagttaaaagtcacacaaaaacaacgtaatttatcgttgcttcaaaactccttctaccatgcaaacaaggaaagaggaaaaagaaagaacttacacaagagctttcatatctgtgaatttggctatttttcaatagagaaaatcactttaacttggctatcagtaccaatgagaacagcaccaagaatggctaaaccacaaatcacacaccttaacaccaactctgtaacccttactctcctatcaattaccttcaaattattcccatgataaactggaacatttccaggacttactccaatgcccaaataactcatctttaacacttattaaagcaattgccttacaaactcaaagctttattttagcttagagaaaacacacaagaaaaggcaattgcatttccaagaaaagttgaaccatgcacttatatagcagagatagtctgtttcacatatttaatgcaacttcattccagcgatacagtcaaatttctctataacagtattactgtaagtatcggcggactcaaaattttgtgcaagcgggttcaatcttataagtatataactttagtcgtaaaatagtttagatggagcagatcatcttgttgtacaacaagcttaggaatgaattatatatttctatccgcgtagtttgttctgtcgtttatccttaatgaaaattttatgttgtcatacaaatataatagatgttgaagatataagtttcaaaaatcctataatcacgtaaatactatgatatatttattatcacaaattttataaatcttttttattttttaaacccattgcaaaattaaactatgtaacataaatgtaagttaagatgcacaagaaatacattaaaatgtaggaagagtttatcatgagttctctcactcatacacatacacatgatgtttttaaccatgtgtacaaattgtggaaaaacacctcactttacatgcataataatgcaatacatagagataggaagaaaaagcaataaatggaacctaatctttgcaattgaatgaaggcaatcatttttttgttttttctgtgtccgatatttatattaaagtccgattatatttggattaatgtcgtatagagtttcattcggagagaagcgttccctatcaaaaaaattttatactcaaaattcgaatcctaaacttttaattaaggaaagaacagtctcattcaccgtacgataacttttgatgtccaacgaaggcaatctgacatctggggttagtattattgagggctaatttttttctgggaagaggcaacagtttcttgtccctaggtacagagagagagtaaggatgagaagatatattgccttaaatcctctattaaattatggtttggtggcatttattatgacccattacttcatgcatagcaaaaggaacacaacgttttttttttttttttaatttttaatttttatattttggatgaacaaataatgcagtgtgaatctaggttggaaaaactaagaaaaattgaaacaaaatcccaaagttgctggaatcataatgaggaccacacatcagcaaggtcgcggtagattgataagtactcattatttttaatcagaatttttagattttactatgagtatgaaatcgtttactaaggatggatttattcagtgtgactttccgaccaaaatctgatctagtcgaatttcaatacagaaacaagcgacaaataatgaggaccacacttgatgtttacttggtgaaagtggtggggcattagttgccaaaatttgggatttttccaaatttttcacaaaagatttggttaattattcaaattgtgcacttatattatatgattaaaagtgcaaagtggaaaagcaaatccagttgcaggtacaactacttcattccactaacaggcgtggttaattgcttataagtgcaaactcagaaagaatttattgattgcatatgtgattaagttgcttattgcgaataatatattacgaggaaaaaaaattatttttttattatattttatatgatacctttattattttatatttttcttttaaatctttaaactcaaatttgcacatccccactaatgtgaaagtactttaataatcgatgcgaataagaaattaggtgggtgactatatgagtttattcttccgtctagtttttacttgagataagagaagcgtgaatgagtaatttcaaaacatttaaaaggaagggtgtgtttggtatgaacggaaaatattttttaattttttttatgtttggttggtttaaatattttagaaaatatttttcactctgaggaaaatatatttattccctatcaagagaagaaaaatattttccacaactttttttctactcttaaccaaatactaaaaagtattaaaaaaagttttccactcgtcaaataaacaattaaaaataaataatagatttataaaattattttctaggaaaatatttttcttcttactaaacacccccgaaatttgtaccgtttctcttttcctttttccttgtgtctaacttacgtgacaatttggttaacgaaggacatgactaattaatttcacacagtacacttttttccctaaattattttagcttgtataagtgttggcctaattgaagattgttttgacgattgataaaagaactcaagtatgaattaggtttatacacagtatatatagatacggataaattcaagcacaatgtatgcacgtaaagtatattagcttaagtggtgatatctgatatctcttgaacgaaaaggttgcataagtgataaggagaaggactccttactcgaaagaactctatcttaaataaggtaggagttagaagttgaagataactagaactcttccaccgtgaaagagtatagctgattctataaattgcaggatgttctcattttacaggtacgcacaaacgttgaagttaaacgtgagttgagagcaaaatagcaagacaatttgcaagcaatatttgtgtgattcaagtgtgcgaacctgaagctacatgaaccagatagaagaaacatttccaagtgtctgtcttttgttctagttcaattgtagtagggtttttcaaattgtacctttcagctttatcaagaagcaattgtattaggtactctgagtattcaagttagagttaatttgaagttgtcgcaacagttagaggttggttgccataacgagattagaggtaatccttaggtttactaataattttgtaaatattgtttgggctcagtgatttagtaagtgtttggaaaaatcctactgagtagtaggtcgtagttttttcaccttttaagtcaggtgtttttcacgtaatatacttgtgttctttattttctgcaattactattttcgcaatagcagtataagaaatacataaaagactcagattcttctataatcagtgcacacgaaaattgggcaccacacaaatcaccctttttgtgtggcattaaaagtataaaacattagtaagatcttcgtaaaacctaattttcttatgtcgtttatggataaaatttgatatttcatgcaaaacatattgcttcttccgtcaaattaaattagacttaattttatatttttcttttaaatctttaaactcaaatttgcacatccccactaatgtgaaagtactttaataatcggagtaaataagaaattaggtgggtgactatatgagtttattcttccgtctagcttttacttgagacaagagaagcgtcaatgagtaatttcaaaacatttaaaaggaagggtatgtttggtatgaagggaaaatattttttaatttttttcatgtttgattggtttaaatattttagaaaatattttttttttctaaagaaaatatatatattctctatcaagagaaagaaaaaatattttccacaactattttttttactctcagtcaaatactaaaaagtattgaaaagaggttttccactcatcaaataaaccaatcaaaaataaatgataatttataaaatcattttctaggaaaatatttttcttcgtactaaacacccccgaaatttgaccgtttctcttttagataaggtaggagttagaagttaaagataactagaactcttccaccgtggaagagtatagcattagaactctagttattttctattctattaactctataaattgcaggatgttctcattttacaggtacgcacaaacgttgaagttaaacgtgagttgagagcaaaatagcaagacaatttgcaagcaatttttgtgtgattcaagtgtgcgaacctgaagctacatgaaccagatagaagaaacagttccaagtgtctgtcttttgttctagttcaattgtagtagggcttttcaaattgtacctttcagctttatctagaagcaattgtattaggtactctgagtattcaagttagagttaatttgaagttgtcgcaacagttagaggttggttgccacaacgagattagaggtaatccttaggtttactataattttgtaaatgttgttttggctcagtgatttagtaagtgtttggaaaaatcctactgagtagtaggtcgtacttttttccccttttaagtcaggtattttccacgtaatatacttgagttctttgctttctgcaattactattttcgcaataatagtataagaatacataaaagactcagatccttcaataatcagtgcacacgaaaattgggcaccacacaaatcacccttcttgtgtggcattaaaggtataaaatgttagcgatactgtgttaaaacagaaatcagaaaactgttagaagaaacagaaaatctgaaaatgataagaaatattccgagtccacaatatccttgtgcgtccttaaggaattttaaccccctcacaaattgccaaggtaatggatttaaatcctcccaggataaaacggaataaaccttcctgcaacagtggcaatacaagctgcaggataccaacgaactcaaagaacggagcaaaatcacacttacgaatttaagagagagagagaagagagagagagagagagactgcgaagaagagtgcagtattcagaagttgattttcagtaaatgaaatggaagccatgcctcagaatttataggcaattattggaagaggtgtgatgtctgttcaggaagaagtgtctgttcagaagggaaagcaacgttcagcattgtttggatttcagttaatttcgttaatgaactgactggcatttaattaactattaaataattaattaaataaattttgtccaaaaaataatcttatcgatcatttgacaaatccaaatccaaatctgaagccgaagccgagccgagcgcgacgacggcgcgagggttcattctcttcaactccttttaagagctctaagaagtgatcttatatttatacacacaagtgtagttatctttcaccaatatggtacaaagttcatgacaaaagcttacttgattcaaatttttattttcctccattttatttcccaccatttccaatttacactcttagtctttaaagcccaatgctttaaagtccaacaatcccccacatgaatgggaatggctgtaacaagaatgatcatagatgaaagttgtgtgatttgcaagtaaggattaattgcatctggataagtaggtttccctttgaactttccgtagtgaacatatgtcggatatactcggtcaatcggtagatttgatatctttgaaccgtcgaactttagtgtatacctagacaaccatatgtcacacaaccaacccttaaccgtcttttggtctcattgttgtgttcgtttcagccatgaacaccacctggtttcataagtgcgtagagaattggccttacagaattctcctgaagcggcttccacttcacacttacataggtgattcctaaacgtgtaatcctttagattgtcaccacatcaaacttaggtaatcattaaagaacgtgtaaagtttatccttgttactaacattgtcttcatcacgagaaggaccaaagattttactttgacaatgttgaaccggtcaatcacaactttgtttgagctccttgaacctagatctcggaatatccaaaattctaggtagagttaccgccatgatgacttgtcctcggccatagtcttattcccttagatgatttctcaactccctctctagttaagccttttgtaagagatccgccaattatcctttgatcttacataatcaatagtgataattccactagaaagtagttgcctaacgtgttatgtcttcgtcgtatatgaagagactttctgttatacataacgctccctgcccgtcctattgcagcctcactatcgcaatgtatgcaataggagccaaaggttttggccagaacggaatgtcttctaagaaatttcgaagtcattcacttcttcaccggccttatccaaagctataaactcttattccattgtagagcgagcgatgcacatctgtttggaagacttcaagatactgctccactccaacagtaaaaacatatccacttgtggactttgtttctgttgagccggttatccaatttgcatcactatatccttcgataaccgcaggatatttattgtagtgcaaagcgtagtcttgggtatatccaaatatcccagaactcgtttcattgccacccagtgatgtttgttaggattacttgtgaatcgactaagtttacttattgcacaagctaatcaggacgtgtacagttcatgatatacattaagcttcccatacacgagcatatccaattgagacgtgctttcacctttattctttacaagataatggtttaagtcaattggagttttgcacttctaaattccaaatgtttgaatttttcaagtaccattttcacgtaatgtgattgagacaaagcagaccgaggagtcctctggattttaattcctagaattacatcggccaactcctaagtctttcatataaatttactagcaagcattcgcttagtagcttgaatgtcggcaatgtctttgctcattattagcatatcatcatacatataagaaaataatgactatatgatttggaacattcttaatgtaaacacatttatcacattattaatcttaaagccatttgacaatattgtttggtcaaatttgcatgccattgcttgggtgcttgttttagtccataaagggacttaacaagtcgcacaccttcttttcttttcccggaaccacaaacccttcaggttggttcatgtaaatttcttctcagatcacatttaagaaggttgtttttacatccatttgatggatttgaagatatacaaggcggctaacgctattagcatccgaatagatgtaattcttgttaccagcgagtatgtgtcaaaatagtcaagaccttctcgctgtctaaatcctttgacaacaagtcttccttgtatttgtcaatagtaccatcgtctttattttcttcttaaaatcatttagaacccaaagtttgttacctggaggaagatcaacaattcccagtgtggttgctcaatatggattctatttcactattgacagcttctttccaatattgtgcttctgaggaagacattgcttccttgaaggtcgaggctcattttctaacagaaagtcagaaaatctggacgaatgaagtgatgtcctttgacgtttacttcttttcggattttcctcattagcataccatctattgtttcctcccgaggtcgttttacttttggtaggcattcactttcctttttatacggataaatagtttcaaagaattcagcattatctgattctattatcgtattaagtggatctcaggattttctgatttatgaaccagaaacgatatgccttgctattggttacatatccaataaatacacaatcaaccgtttttgacctatttcacccttttaggttaggaacttgtactttagctaaacacccccacactttgaagtatttcaagctggtttccttcctttccacttttctagtgatggactgtgttttactgggtacacggttgattattcggtttgctgtaagttagcttccccccacaagttctgtggtaaccagaacttatcacaagcattcatcatctcctttaatgttcgattcttccttccgcaattccgttagattgagagagtaggggagttgtttggtgaataatgccattttccaaacatatttgttcaaaaggagattcatattccccaccctatcacttcttatattttgatctttttgtttagttgtgtttcaacttcattcttgtattgcttgaatgcatcaattgctcatctttactattaagtataaacatagcatactcgtactatcgttaataaaagtgatgaagtatttttcccattgcgagatggcgttgacttcatgtcgcaaatatctgtgtgaattaaatctaaaggacttgaattcctttcgactgacttatacggatgcttagcatactttgattccacacagatttgacatttgaattaatgcaatcaaattttggcaatacttccaaattaatcatttccgtaatgttttgaagttgacgtgcctaagcgcgcatgccataaaatgtttgactcaactaagtaagaagaagcttcaactttattgataggaataactattacatttagcttaaaaagccctcattcaggtaacatttgcctacatacattcattcttacttagaacaacactattggaaacaaatacacacttaaatctatttttgacaagaagtgctgtagatactaaattcttgcgaatttctggaacatgattaaaagtcacaatttttccggatgtcatcttcaatgcaatcttgccaactccctcgattttggccgtagatgaatttcccataaaaagagttgttcgggtcctcgggagcataagaagagaataaatccttgtttgcacagatacggcgggtggctccagaatcaatccaccactctctcgtatttcctaccaagttgcattcaggcaacatggcacacaagtcctccacttctaccactttgcttgattcttcttctttcgtgactctttctttggagcacgacaatatatggccttgtgcccggattttcacagttgtgacaactacctttgaacttctttcttgttcgggtaattctttggtccatatgcctgctttcttttctttttatttcccggtgcttcctcaacaatattagctcccattattgccgagtagccacgtgacttcttttcaacattttgtttcttcttcttctatccttagatgaacaattagatcctcaagtgtcatctctttgcgcttgtgcttcaagtagttcttaaagtccttccataaatgaggtaacttttcaatgaaggcagcaacttgaaatgcctcatttatgaccataccttcaataacaaatttataattaataagactattaatatcattaatagaattattgactcgggtcataccttcagcaaggagatcatgcacgatgacttgtaattcttggacttgagtgatgaccgacctagtgtcaatcattttaaactccaaaaattttacagcaacaaacttcttaagtccagcatcctcggtcttgtactttttctcaagagcgttccataactcttttgaagtttccatgacactataaacattatacaagtcatcttccaaacaactcaaaatgtagtttctgcataggaaatcagagtgtttccatgcttcaattatcacaaatcattcagcctcaggagtatcttctcccacgactagaacatcatccttgatgtatcgttgcaggcttagtgtagttatatagaatagcatcttcatctgccaacgtttgaagtctgtaccgaaaaacttcccgggtttttctgccggtgccattgtatgtgctggtcttgacgaagcagcagcactcgataaacacccgttccagcagcatttccattagtttggttttcattcatcatatttctgtagagttgtacacaaacagaactttgttaaattagtaaagttttgatatcttcaaactgaattccaaaccaaacatacaatacgtaacaatggtgaagtttttatatacttcaaacccgtacgtttattattccggtaaagttttgatatactttaaaccggacagaacaaatattggagtagaaagcactacgctttagtctccaaaccagtacacaaaagatagataacagttcaatataaatttcaacacataaacgttaaaaaaaaaattccttaagcttgtttgcgatactgtgttaaaacagaaatcagaaaactgttagaagaaatagaaaatctgaaaatgataagaaatattccgagtccacaatttccttgtgcgtccttaaggaattttaaccccctcataagttgccaaggtaatggattaaatcctcccaggatgaaacggaataaaccttcctgcaacagtggcaatacaagctgcaggataccaacgaactcaaagaacggagcaaaatcacacttacgaatttgagagagagagagagactgcgaagaagagtgctgtattcagaagttgattttcagtaaatgaaatgtaagccatgcctcagaatttataggcaattattggaagaggtgtgatgataaattttgtccataaaataatcttatcgatcatttgacagatccgaagccgaagccgaagccgaagccgagccgagcgacgacgacggcgcgagggttcattctcttcaactccttttaagagctcttagaagtgatcttatatttatacacacaagtgtagttgtctttcaccaatatggtacaaagttaatgacaaaagctcacttgattcaaatttttatttccctacattttatttcccatcatttcccaattcacacttttagtctttaaagcccaatgctttaaagtctaacataaaacattagttagatcttcgtaaaacctaattttcttatgtcgtttatggataaaatttgatatttcatgcaaaacatattgcttcttccgtcaaattaaattagacttaatgttcttcctagttacaacgttggtggacttttttttaatctattcatttacctccttaattaagtgataaaatgctacgtatttaataaatcaagaagtagaaaattcatgttcatttaaatcataagtgatgttatgaaacaataaaagaagaaaaataatattgcagagaaagagagagagaattcttgttgaattttgggatgaattacaatagaatatgactcatctatttataggaaaaaagtgacttagccaccaagtaaaatccctaaaatctctctaaaatatagacattcaccgtaaatagaattctatttataacaaacgaaaacttttaactaacaactccaatctgaacgaattattgcacttcttaccaagttgaattaaaatacctattttagtatttttctttttgaaaaaattaaaattaacattaaatttgcagcaggcaacaaacgacaggctaagatcttgcattcaaaactatgattttgactgatagtcaccatctatcatttatccatctcttctatatatcgtgtggcaatatcatcactattcacctacgagaattctatcataaatgttagaatttcccccccccccccccaaaaaaaaaaaccacccccacacaatttattttcactctcgagccttgcatttcgtagaaattcaccgcggtaacaacttaaagggctgttatttagaaattagtcagtgcatcatcaatttcagtttttcaatttaatttttcatgacaaaattatttcgaattgtcatgaaattctgatttttagtttaaaaaattaagagtttttgaggcttctttcagtttcttagtaagaataataagtattgttaacctctaaataacatccttaaaatatggctatatgtgcacttgtcccttacttttcttgtaattggcccatagtcggcccataatatcttcgtttatttgcttgcctccttttagctcagaatatataatattacgtctattatataatgctagatattaaataatgtctttgttcatttgttttaagtagcatgaacaagtgcacgtgtattcacaaaataaaactgttatatggattttccaagtaaaaaggtgattaatcagagttgatatttatgtaaattagacctcgtttatgattgtatagttgaaacaattgaattgggaagtgtgtctacttgatagacaaatgataaggaaaacccatattcacgattaaattccataatgtttgggaaataaatttgtatgtcagacaaattggaaaattcaaagatattatgcatttatcttattcatgaaataaatgataataattacttgtagatgtaaatattggccctcttttctttaagaagaagaatttgcttcttctcagaattttctgcttttatccccacattttagacccaactggtttttgttcacacatgcatcacatcatatggtcctccaccccactaaaacctcttctttttctatacttacttttattagactataaaactagattatttggcctgatcacccgtccatgatgaacaacaaagttgtggttaccactcgtacattcaggcctcttcataatagtatccctatacaacaatatttctctataaaaatcaagcttttttcgaaatcagtttttatgttatattataatatatgttctctttaacagctcctcgctataacatctaaaaaaatttggaacaaacgagacagttatagaaaggattgacgaacgagtaaaacaagtaagcagacaattaaggtgtgtttagtacggaggaaaatgtttccataaaaagtgagtgaatttatgacttattttcacatgtttggttatgtttggttggtgaatgaaaagaaaatactcgcatgttaaaatgaaaaaaataccctatccataaaatgtaaagaaagtactatcaataatatttctatttagggtggtgatgagtagagtgaggggtgaagcgagatgagtgtggtaggagaggggggagaggttggggtgattgggataaggtaaagaaggttgaaaatgagttttaaaaaatattttctcttctcttgatagggaaaacattgtcccctaattggaggaaaatgatttcacgagaaaaatattttttaaaacctttagccaaccaaacatagaataattgaaaaatatttttcgaaaaatgttttccttcgtaaacacaccctaatagtaaaaataggccgagctttgtaatttagatcaaattcatacctagacaacgttctcttaattaccaggatagcagcttcgaagtaaatgtagtccaaaagcctagagtgcaaaattaactcaaaaattgcagatacgagacagtactacattggaattaaagctccacacatgaaaataagagctcattcttcatcatcctcatctccatctccaccagaagccttctttgcagcagctttttggttctttctctttactcttccaggacgcccaccaccgaaaggactagtgagagagaagtcaatgtgcttctgggagtccagtctcaccataaaggatggaacattcaccacctgccttccaaccctgcaccacaacaatattagtacgtccaaacccaaagaaagaaaactgaggaaacctgtgggaaatcaagtgtgagtgtcgaaaggtaaagttgatgttcatagaattatataaagaacagataactcatagaaaactacttcgcaaaatagagtatatgagtttgcaaacctcacctgatttcaatctattagcgcattaacaaataatgcaatagatgacacgtctaatttatgcttcttctagttaacaaaaaatctgttggtttttagtataacaagtacaaatttagcttctaagaacacctagaaactcaaaccactttgagatgcattaacataaattacactcagcaaataaacaggatcttctcaagaaaatggacgattctcaaaactctatgattcaatcagattccatgtttatgaaagcaaaaccacttccacaaacaacagataatatgtccttgttgagatattattctgataaactggttttcacaaactcgctgtgagaatattgttttgttcaatagcaattcaaaacaatagggaacataaactaattgcatcgcataatgcatccaaaataaaaacaacctcagtttacagaaacaatcgttagaaatcttcagactaagaatcttggttccttagttaaggcatcttgattaaagccttcaggttatattctgaaagactgaaaccattaggtcaaaagaacttcgacttttagtagagcacctaaaaaagaaaagccaagaccagaaaataggaacttcgagaagagcacatctataaaaacatttctagtctgaatatcacatttatgttaaagttctttagcggaaaaaatgcatcataaatgatatttttagaaagaaaatacatcgaaacactcatcacaacgtctctcgaaatgtgcgataaaaggctagaacaattgctagatattaaactgctcgtctatcaaccatatcataagagccacatgccattgcgccatagcagataattaaaaaagtattcacttcaggatcccgctaccatacattcaggcacagcaaaaattgtaaagaaggtatagactaagcttgtttatttgaactttgtcactaaaactggcaacaaattttacctgatatgcctttgcctaattagcactcttgcatgatggatagacttagccatgccagtcttgaagacgagggtttggagacgccgctcaagaaagttctccacagtgagagacaagacataatcgagcttgttctggctctcatccaataacccatatctcatcgttcatcctcctcatgagtgcttcgccttcaaaaatacgacgtgggtccttctcgtctaatgtcagaagcattcttgcagcatttctgatacggctcaaagcatactgaactctccaaagctccctcttgcacctcaatccatattctcctacgagcttcaactctgcatccaatcgctccttttcatagggacgacgaggcttcttaaaggtcttcccatctgaggtacatatcgaattataaaaataaatataagctaaaactattaagataaaacacagatagaaacaatggtatgcatcttgaagatctttaaaaagttattaatgcatgtcaccggctttttttcaaattaagttcttttgtcagctgacaatacactacaatttcatacaaagagggtgtttggattgacgtataaaaagcagcttttaagctaaagccaaaagccataagttggtaatacccaacttttggcttttggcttatttttctactttttatgcctaaaagtaagtgtttttaagcactttttatcattgccaaacaccacacaaactaaaaaagtgcttaaaagccactaagcacttaaaataagccaatccaaacaccctcaaaatttgtagtggattgtcaaaataaaaacccaactcttctaacataatgcaatccaatccatactaccaagaattttaaaaacaaagacagtgcactaagctcccgctatgcacagggtccggcggaaaggccaaaccacaagagtttgatcatacaaaaacatgcatcaacccaaaaatgagctggggtagcctattggatcctttgggcatgtttcgttccaaaaagatgatatttccttagggacaaagtaggcggtaccttacaactactctaaattctttacatctctccgcggacataaaaatctctaaaatatcccaatatttatcagctgcatgaagaaatgaagttccaatacaatggcataaagcattataacatcaactcttctaacattatgtgtccatattaccaagtatatgatcatacaaaaacagtcatcaatcccaaaacgagctgggtcagctattttaaatcttctatatctttctgctcaatttgggcatgtttcattccaatattaaaactagagattctcgaaatcttttacatccttccactgacatacaaatctctgaagaacactgcgcctaataccaataacagctaccaactactaatttgtatcgcttattagattctttagcttcctaattactaaacgacagagaaataaacaggacaaatacaaacaatcgtgattattcagacatcaaatattatataaataaggaaattacaccgcaaacggataaagaggaagaacacaaatttgaagacttacagttacgataaaaggcgacgtggaccatgttttccggttaccgccgctgtcgtcggcgattcgtcggcgatctgctgaagggaacgggaaggggaaaggaaatgatcagaaactagggttttcagctagccctttatagttcagctctaatccctaatgggctataatgtctcataactgatatgggtttaacatcaggcccaataattttattttatttcttttataaaaaatatctcagctcacattttattttgaagaattaacctaaatagcagcccactcaatcgcttaaactaaaaatagcttatgaaggtataatatatgcataattcatgcattatatgtaattatgtataatcaatgtataaactatatatgactaaaaaaattaaggatgaatatgggcggctatttatgtaaagatcccaataatttatgatttattttaatttttcattcggtgtttagtattgaggcgtaagttaattcgggttcccactttgtaaggcccattcaagaagaaatactttttgacatgaattttttcatatccaagactcgaacctgaaagcactggttaaagatggagggttcctatctttccacaacaatacttgttagtttttattttcaattaaatcgtgcgccccaaatcttagattctaagaacttttatagaaaattttatgtgaacttttttttaagaaaaaagttttggcatttgattgcggagtgagaatcactttttcaaaagaattgttaaaggttagtaataatgttagtttcttgagccgagagtttttcggaaacaaccactctattccctcggagaaggggtaaggtttgcgtacacactattctcctcagacctcactaatggaattttactgagtagttgttattgttgtagtaataatgttagcaaacgaaagtgattaaattaaaataacttgatagcaatatgtaaatattagttgaattagtgattagattaaaataacttgatggtaatgtgtaaatgttagttggagcagtgacataaacataagaattaagataattataattataaatgatatccgcttaaaagtaagaataataattttttccttttggtagaaaattttgtttgacaaaaatattttgataatcaaacataaaaaataacgtacttccttgtttttgttgattctgatttgtagtatgtggttgcacttgcaactcagcttatattattttttgcatggcttcaactttatcaaaagcattgttctcttctaccttttacctcttcactattacgaacattcattgtaaccaactaaattatctttagaagtaataattattaaacatcacaaattaattttaattttaatttattattatttgatctttattgtacttgtgagctcaccttcttgaatcatatttcagaaatgtaggaaaaataatagattatattgacaaggaacaagacgcaaagaagaacaacttatcgaaaaatattgtgttgtggcaagctattatcttgaaagcgatttcggcctgattggatgcttctcacggttccacagcacttccagacatgtgcattcgtgactagaagtttagaatttgcacaaaataattgcccggaattaagacatgttacaagaaggagaattaaattaggggttatgaaaataaagggacgttacaatttaaattatagttgttacaaaattcatggattagcctcacgtatatctcgcgtacagaacgagggggcaaatcgacccgttttgcgttcaggccaatttctcatgtgcgtgagaccactctctattactagctctttacaagcccaacaaagaacaattcaacataaagaatagtcagatttacaagtggtcattcaaaaatagtcacagtttcaaaagtaattaaaatttagccactttttatgtaaagataaatctgaatgaaaacactgttcgaaatccagaaaatactccagcataatatactggaattatactggagttccagcatagatatactggatctccagtagaatatactggacttccagcataatacaatagaattctagtataatattcggtccaacataatatgctggaagttcatatacaagtggtccaatctccagtgtattatgctggaactttccctgtgttggagttccagcataatatgctagaagttcatacacaggtgcaccaatctccagtatattatgttaagtctaaatgtaagtttcaatgatgacaacctatttacattgattgcagaaatcaaggtatcaacaaaaggaaagataagttgtcaagaagctgtcaaaaggaaagaagttgatgatatctaaactaaagaagatgatgctgaatcaaatgagctgatgatgtttaaaccaaagaagataatgctgaatcaaaggacaagaagtcattaaaaaaggaaaccaaatatgttgtgtcctctcagtctcaatcgaaggagatcaaaactatcaaataaggaaatatatcaagtgaagatcagaatatctggcatcttcaatcagcaaagtcaaaggctcaaatttctccataaaataaggacgtgacaaggaaagtcatgaacgagcagcccttctcaagtgcaggattcgagaggcaccctttgggtcaaatctcttagaagattttgtacctcactcaagataaattgcaacggctctcaaactccctataagaagtctgttcagttcatcaagaagacgcgcgtaactacaaacattatcttctaagtctctttacttcttagcataaacaatgtatttttcagtttaccagtatcataaaagatagaaagagctggaacacaaaagagagttgtgtaaacattcaagatatatagttgctacacttcgttggtgtgaacgagttaaaaccatcattgttgtaattattttcaagatctaagagaacccttgtgacccaagggaaattggatgtaagtactacaccggtaccgaaccaatataaaaattattacgtattgttttgttttaatattctctttgtttatctttatttgcattctgcatgagatctagttgactaaactctttcttactcaactaatttttaacatatcacaattcaccccccacccctcccccttcccctcttgtactttcaattggtatcagagtgaggcgcacaatcttttcttaacagctaatgagaaaaagatcatgagatctaacattatttttatgcattatttcaaaaaggaacctctcaggttcgacctccctacttcaacggaaaatacttctctcgttggaaggttcgtatggaaacatacacaatgccatatgacatcaaagtttggcatgtaatcaaaaagagaaatatcctaattccaccaaataaagatgcaaatggtcaagtaatcgtatcaactgatccacttgacttagatgattacactgacgaacaagctgctgtcgtaactgtgaatgccaaagcaaaaaatctactgtacaatactatcaagggagaggagtacgaaaagattttaagttgtgaaactgctaaagaaatatgggataaattggaggtcacttatgaaagaaccaacaaggtgaaagaatgaaggatggagaatcagtggaaaagatgttctccagattcaacaaaacccttgggatttgaaatcttttggcagaccaattaaaagtggagaacaagtcagaaaaattctcagaagtctatccatgatttggcagccaaaggtcatcgccctcgaatgtcaggatcttgacaaaatgtcctatgatgaacttagaggtgatctaattgcctttgagaaaactcacttggataagcaaattcaacaagaaaagaagaaaattgttgcttttaaagcaactgtggttgaaccagaaaatgaagagaaaaaagaaggaggagaacaagatgaaaacatagccatgctttctcaagttttaataagcatgatgaggaaaaacagaaatagcagaacggggaaatctaactttaggaacggaaggataaataatgaaactgataagaatgatggaaggtgctatgaatgtggtaaatttggacacatcaagctgattgtcctgaactaaagaagaagctcagacgaaacatgcaaaagaagaaatcttttggagcctggagggatacagaagaatctgatcatgaaaaaattgcaagtatgtgcttcatggctattgatgaaaatgaagattcaggggagcttggattgatggcagatgaagaagcaaatgagaaagaaaacctaaatgaacttggccttatgacagacgaaggaaccagtgaggtacgtcttcctacatgtcccaactattatgaacttcaggaatttattaatattgcccttgtagatattgaaagagttctggatgaacttagaaagatcaaaagaaaaaaaaagggtagggctttgaagttggaagtgatagcaacgtgttgttaataggaagtctgtgaaattgagtgtgatatgctccaagattaagtaaatgaacttcaacttcaactgaatgtattacaaaaatctatcagtcatagttctatcaaattaactcagattgctcctcaaaatcttaaatctcatgcatgctccttttatggcaaaaatagtcataatactaaccaatgcaggaacacaatcagagcagaaatgtgatgacccaaaaggtcatcccttgttttagaagccaaaattgtgttccaaggctttgaaaacctccttttatctcacctaatattgcatacacagtccgggcggatatccggaaagcttttatgtggaaaaaactgagaaaaattactaattttgcctgtaaaattgaatttaagttgacttcggtcaacattttaggtaaacagacccagacccgtgatttgacggtctcggagggtccgtagaaaaatatgggacttgagaatatgtccggaatcgaattccgaggtcccaagcctgagaaatgaatttttgaaagaatttgttttactgaaaatataagagttttggaaatttgattatatttgaaattgatgatatcggacccgtatttttggtttcggagctcggtacaggtttaatatgatatttgagttgtgcctgtaaaatttggtaagaaacggaggtcatttgacgtgattcagacctgtagatgtgaaatttgaaacttttaaagttcttgagatttttccttgattttaatgctaagttcattgtttaagatgttattttggcgatttaatcatatgagtaagtccgttagaatatttttaaggttgtgtacatgtttggtttggagccccgagggctcgggtgagtctcggataggcgtcggagtggtttggacttagaaaatctggtgtaggattgctgtttctggtgtctggtgtcttgtgcgatgcgaatgcgtggtcacccacgcgaatgtgaagagtaatctgggctggggctgggtttcttctacgcgaacgcgagaccttggtcgcgaacgcggagcactgggggactactctacgcgaacgtgacagtcaaccgcgaacgcgtagctttaggatgggaactgtgggagggggatcgataccctatgggaacgcggccagcggcttgcaaacgcaaaggccaatagggccgctgctacgcgaacacgacagacctctcgcgaacacgaataaggtttgtccagtgatcttaaaacagtaaaaaaacggaattttagccaaaacttcatatcttcaaaaccaaggcagcttaggggcgacttttgaagagggatttcaccataaaatcataggtttgtgttcttaaacttattttctttattttccattaacacccattagatttctaggcctaaatcatgttcttaagggtataaaattggggatttgggtagagttaggactttttgaataattgaattttagacctcgttttggggtcggaattcgaaattaattacatattcgggctcgtgggtgaatgggtaatcgggttttggtctgaacctcatgttttgaccaagcgggacccggggtcaatttttaactatttgggaagaatgatagaaaacctaaaattaagcattgggattgaattacctagcatttgttgatattattaagttaattatgtctagatacaagtgaattggagtcaaattcaaaaggaaaagcggtaaccgagacttgagtttggtcgtggaattcgaggtaagtgtttggcttaaccttagcttgagggagtaggtgtgtgtcctatttgctacatgttattatcatgttcaacgtataggtgaggtaacgagtacctatacattggtgtcaagcatgcccgtaagtcgaatattgtgatttatgtggttcttcgttattacttgagtttcactttgtagttatccatattggtggaaattcttgataacgttcagtgttgagtattgttttcagttaagaaactttatgtaaggttatgtactaagtgagattggttatagttgtttcccttgctgggatggtattgattctattgttgtttcccttgtcgggacgttatggctttattgttgttgttaaaatcttgattttccttgccagattgttgttattattttgtttgggtgaggaagagtgtaaagcacgaagggtgatgccgtgtatgatttattgtgaggatgagagtaaaagcacgaagagtgatgccgtgtcgtttccattgatttattgtaaggatgagagtaaaagcacgaagggtgatgccgtgcatttctatttattgcttggtgaagatgagagtaaaagcacgaaggatgatgccgtgcacttgttttgtgttaccatttctgttgtttaaattgatatctaattgttgctttactttgttatttccattatgtgatatttcctcccctcagcatgttcccctttcctttatgcttagttgcttatttcttgttgttatcattgtccccgtatattattaaactgcacaagtttatttggttgtcgtgtcctagcctcgtcactacttcgccgaggttaggctcgacacttactcagtacatggggtcggttgtactgatgctacactctgcacttttgtgcagatcctagtactggaactttcggaccatagtttgaggttgctgccttcagtccagtggagacccgaggtagtcctgcaggcatccgcatgtattggcgtcccttcaatcctgtttcttttctgctcttagttacttttttgacatatgcatatttatttttgttcagaccactatttatagtattcgtagacagtccgtgaaattgtgacaccagttctgggtatagttttcttatggatttcgaagttgtattaaattaaaccgtcagtttctgttatttcgcattttgatttccgttaattttatatatcatatagcaaactattaaggataaaggaaaaaatgtaagataatcggtaacgttggcttgcttagcgggttcaatgttaggagccatcacggtcccgacggtgggaaattcgggtcgtgacaattggtatcaaagcactaggttgcttaggtctcacaattcacggacaagcgtagtagagtctgagggatcggtacagagacgtctgtacttatcccctagaagctacagagtttaggaatgacttcacatctattcttctatgttgtgcgatttgaattctcaatactaattgaatttctactctattctctcgcagatggcgagaatacgtgcttcttcatccactgatcagcagcctgagtctccagttgcagctcctatgaggggccgaggacgaggacgaggccgtgctagaggctgaggtaggggcagagctcagcccagagcagcagccctagtggcagagcctcaggtagagtttgctggtgaggttcctgcccagacagtcccagtcgggccagctcaggttcccgaggggttcattgttaccccggtactccaggatgctccggtccatcttgtgggcctcatggagagtgtcgctcaggcaggtttacttcctgtaacaccagccgtctccaaggctaggggaggagtccagactcccgctagtcgcactccggagcatatggctcctcagtttcagactctagcagctcagaccggagatgtagcagctatgtctactgatgctttgtggaggttggacaggttcaccaagctcttcactactacttatagcgacacatctttagaggatccccgagattatttggatagctgtcacgaggttctacagaacagggatagtggagaccaatggggtcaactttgctacttttcgtctgtcaggttccgccaagacttggtggagagattattgtttggctagaccagctgggtcaccacctttgacttgggcccagttttctgagttatttccggagaagtttcttcctatcacttagagagaggattatcggaggcagtttgagcgtctccaacagggttctatgaccgtcactcagtatgagaccatattattaccttggcctgtcatgctcttatgatacttcccaccgagcgagagagggtgaggagatttattgagtagctcaaccgtggaatctcggtcaagaatcaggaacgcgcactggacgggtaactagatgcacctgcctcagatcctgtacaattaagtacagaagcgtagtatgggtacataaacaatatgaacctagtaagtatccaatctaaccttgaagaagttgtgacgaggggtcgacttgactctcattagggccaataatactataatctaagtgctacgctaagcaggtataacatgagtaataatgacagtttaacaacaaggagaggtaagatattctttcataaatgtcatgtcaatctcagtcttatcatgtaacaacttacatttcaaagcatttaagcaatataaatcacgggaagttccaaataaataacatgcgcatatcacgccaaggtcgtacgacctgatccaacatagtattaaactgtgcactaccataggctcgaatggcgcgaattatagatgcatctatttactaccgaggggttcggcccgatccataaatagtaattattattaaagaaacacaaatttctcattttacagtttgaacttaacctcgtatgaacccttttttcaaattttaacacgactcaggtaattaaatagcaagtaagggctcaaataattcaaataaagcatggtacgggtcctaaattacccgaacaatagcaaaatagtagtcacgtacggactcccgtcacttcatacgtacgtagccccacaaatgggtacacgcatttattaaattcgcctacggggttaattctctcttacaaggttagaaatgagacttaccttgtcccaaagcttactttcaaactccagaatgcgctctaaccctcaaatcggagccgaatgatccaaaactattcaaatgggtaacaactaatcaatatgtgctcaagagttcatattttatctattatagtaatttcctaaccctaaatggttcctaaaattcatccccgagtccacatgcctggattccataaattttttaaggaagttgttacccatgaactaaggaacataaatatatgatttttcactaagttccataaccattttcgtggtaaaactctatttttatcaaaccctaggttttcacttaaactcttgatttttcactaatttttgcatgttaatctacccataatctagtatttaactcatgttgtatagaattacttacctcaaagtgctaggtgaaagcctccttccagctgctctaaatatcgcccaagagttgaagtgaaatgaaataaatggcctaagtccgtattaaaagagctgcacacaggtttctgatgtcgcatttgcgatatctggttcacaaattgcaaaggtcgcaattgcgacaaatgcatcgcaaatgcgaacctgcgctcctgcatgggtcacaaatgcgacaaatagggacgcaaatgcggttctctgctgggttcgcaaatgaacaaaatgtcacaaatgcgatcgttgccagctcaggcatcttcagaattgcgaagccttcatcgcaaatgagatgttcacaaatgcgaacaaatcctcacatttgcgagacctacaacagctgccaagaaacaccagaaaactagagtgtttttcataaggtcatttgacgtgatgacccaaaaggtcatcccttgttttagaagccaaaattgtgttccaaggctttgaaacctccttttatccacctaatattgcatacacagtccgggcgaatatccggaaagcttttatgtggaaaaaactgagaaaaattactaattttgcctgtaaaattgaatttaagttgacttcggtcaacattttaggtaaacagacccagacccgtgatttgacggtctcggagggtccgtaggaaaatatgggacttgagaatatgtccggaatcgaattccgaggtccaagcctgagaaatgaatttttgaaagaatttgttttactgaaaatataagagttttggaaatttgattatatttgaaattgatgatatcggacccgtatttttggtttcggagctcgtacaggtttaatatgatatttgagttgtgcctgtaaaatttggtaagaaacggaggtcatttgacgtgattcagacctgtagatgtgaaatttgaaacttttaaagttcttgagatttttccttgattttaatgctaagttcattgtttaagatgttattttggcgatttaatcatatgagtaagtccgtagaatatttttaaggtttgtacatgtttggtttggagcccgagggctcgggtgagtctcgataggcgtcggagtggtttggacttagaaaatctggtgtaggattgctgtttctgggtctggtgtcttgtgcgatgcgaatgcgtggtcacccacgcgaatgtgaagagtaatctgggctggggctgggtttcttctacgcgaacgcgagaccttggtcgcgaacgcggagcactggggggactactctacgcgaacgtgaccagtcaaccgcgaacgcgtagctttaggatgggaactgtggagggggatcgataccctatgggaacgcggccagcggcttgcaaacgcaaaggccaatagggccgctgctacgcgaacacgacagacctctcgcgaacacgaataaggtctgtccagtgatcttaaaacagtaaaaaaacggaatttagccaaaacttcatatcttcaaaaccaaggcagcttaggggcgacttttgaagaggatttcaccataaaatcataggtttgtgttcttaaacttattttctttattttccattaacacccattagatttctaggcctaaatcatgtcttaagggtataaaattggggatttgggtagagttaggactttttgaataattgaattttagacctcgttttggggtcggaattcgaattaattacatattcgggctcgtgggtgaatgggtaatcgggtttggtctgaacctcatgttttgaccaagcgggacccggggtcaatttttaactatttgggaagaatgatagaaaacctaaaattaagcattgggattgaattacctagcatttgttgatattattaagttaattatgtctagatacaagtgaattggagtcaaattcaaaaggaaaagcggtaaccgagacttgagtttggtcgtggaatttcgaggtaagtgtttggcttaaccttagcttgagggagtaggtgtgtgtcctatttgctacatgttattatcatgttcaacgtataggtgaggtaacgagtacctatacattggtgtcaagcatgcccgtaagtcgaatattgtgatttatgtggttcttcgttattacttgagtttcactttgtagttatccatattggtggaaattcttgataacgttcagtgtttattgttttcagttaagaaactttatgtaaggttatgtactaagtgagattggttatagttgtttcccttgctgggatggtattgattctattgttgtttcccttgtcgggacgttatggctttattgttgttgttaaaatcttgattttccttgccagattgttgttattattttgtttggtgaggaagagtgtaaagcacgaagggtgatgccgtgtatgatttattgtgaggatgagagtaaaagcacgaagagtgatgccgtgtcgtttccattgatttattgtaaggatgagagtaaaagcacgaagggtgatgccgtgcattttctatttattgcttggtaagatgagagtaaaagcacgaaggatgatgccgtgcacttgttttgtgttaccattctgttgtttaaattgatatctaattgttgctttactttgttatttccattatgtgatatttcctcccctcagcatgtcccctttcctttatgctagttgcttatttcttgttgttatcattgtccccgtatattattaaactgcacaagtttatttggttgtcgtgtcctagcctcgtcatactactcgccgaggttaggctcgacacttactcagtacatggggtcggttgtactgatgctacactctgcactttgtgcagatcctagtactggaactttcggaccatagtttgaggttgctgccttcagtccagtggagacccgaggtagtcctgcaggcatccgcatgtatgcgtcccttcaatcctgttttctgctctagttactttttgacatatgcatatttattttgtcagaccactattaagtattcgtagacagtccgtgaaattggacaccagttctggtatagttttcttatggatttcgaagttgtattaaattaaaccgtcagtttctgttatttcgcattttgattccgttaattttataatcatatagcaaactattaaggataaaggaaaaatgtaagataatcggtaacgttggcttgcttagcgggttcaatgttaggagccatcacggtcccgacggtggaaattcgggtcgtgacaagttggtatcaagcattagggcttaggtctcacaattcacggacaagcgtagtagagtctgaggatcggtacagagacgtctgtacttatcccctagaagctacagagtttaggaatgacttcacatctattcttctatgttgtgcgatttgaattctcaatactaattgaatttctactctattctcgcagatggcgagaatacgtgcttcttcatccactgatcagcagcctgagtctccagttgcagctcctatgaggggccgaggacgaggacgaggccgtgctagaggctgaggtaggggcagagctcagcccagagcagcagccctagtggcagagcctcaggtagagtttgctggtgaggttcctgcccagacagtcccagtcgggccagctcaggttcccgaggggttcattgttaccccggtactccaggatgctccggtccatcttgtgggcctcatggagagtgtcgctcaggcaggtttacttcctgtaacaccagccgtctccaaggctaggggaggagtccagactcccgctagtcgcactccggagcatatggctcctcagtttcagactctagcagctcagaccggagatgtagcagctatgtctactgatgctttgtggaggttggacaggttcaccaagctcttcactactacttatagcgacactctttagagggtccccgagattatttggatagctgtcacgaggttctacagaacatggggatagtggagaccaatgggtcaactttgctacttttcgtctgtcaggttccgccaagacttggtggagagattattgtttggctagaccagctgggtcaccacctttgacttggcccagttttctgagttatttccggagaagtttcttcctatcacttaggagaggattatcgaggcagtttgagcgtctccaacagggttctatgaccgtcactcagtatgagaccatattattaccttggcctgtcatcttaggtaaaaatatattatatagtatataatatagaagatgttacataagagaaatctataatgtcaagggcataatatattttcaattaaaagtattataaatttggtcaatgtgacttctatcaaaaagatggacaatcaaacctattctcgattcactcaaagaggtgaatagggtcccaatagagaatgtaaaaagcaggtccgattacgcgtattcctaatcctaaatggaatgtaatgatgtaggaatccatatgtaaacatagtatctatttagataggcccgaatgaccccttctcataatgagaatgtatataaccctattccggcctggtccggtatggaagaacttataatcatggaatcgactcgatcatcagattataagttcataaccctagcccattcccattttgacgaacagatctactaattctttgattccagttagtaggagacatctctatttttcccccggggaatctttagaattcccactgcttaactttcaattcgcctctgaccatcaaatgaaatgtgaataacccgtcctcctctctttgaaagaaggggcgcttccggttctgtcggtgcttgaaacaatttttcttctccatattactatactctagagtcaataattttatatgaggaactactgaactcaatcacttgctgccgttactctcagttttctgttgaggtctatccgcagaggtactcaaattggatcagtgatcgatagccgtttgttccggtataaatagtcattatctgctcttctaccgtgagaggagctgattgggattgtttaagcaattcactaatcgttgacctcttgccaattgattctgagtagctttatcgagatcagaagcaaattgtgcaaaggcttctaatctgcgaattgtgctagttctaattttaatttaccagctacttgtttcatgctttatttgagctggcggaccccactctggaaacagagatacccacattaataggcgggctctgattccagaattgaataggtcggcggataagaagatttgtccatcagtaatggaaattacattagtaggaatataagccgaaacatctcccgattgggtttcaactattggtaaggcggtcatacttccttcacctaaactagaacttaatttagcggctctttccaaaaggcgtgaatgcaaataaaaaacatctcctggataagcttcacaccgggcggtcttcgtaatagaagagacatttggcgataagcttgcgcttgtttggagggatcatcataaatgattaaagtgtgtcgttcacgataataaaatattcagccaaagctgctcctgtataaggagcaaggtatgtaatgtagcaggggaatctgccgtttcggctaccacaatagtgtattccatcgctcccctttcctctgcgataaataaaacaaagtaaaatgatttttgcaataaaagaaagaaaatgacttttgaatgacgaatacaaaattgaataatttttacgtaattaaaaaaaaaaagactttgcttaatgaatataaagttgtatgacccctcaaatttacttgcttttaagtttcaaaatctattatattctagggaatcaacagcaaaagattaatacatattgattttccaactatatgctatagctagctgttactctcgtactaattgttatttcattcaatttctttctactttcatgcacttgatttctcttcttcttctttttttttccttaatttaatttactaagatattcatttactcatgacgtgcgttagccgttctagaaaatattaaatataaaaaaaatgaattctggagattgagaatatttaatgaggttaaagatcattagcaatattatttttcataggaattgggatgattgcgtgaaagagcaacttggaaccttttttttgttataataatgcggtgtcggaccagcctgcacgcacttgactaattttacaaggtacagaaacagataactctatccgtcaaggctttaaaaagatacatatttagatattaaggttaattagacttaaggtgaacgactgatcggtattaatctgtgacagatctagaattaatattacgagttcaaattaagcggaggaaatggtcattaagtctgacttcgaaattaaaattcaaaacataatatttatattaattttcagtgttgcacatggtttaaataaaaaattatgagttcaattgatcttaaaccttaaattaattaactaaatatcagccactgattttactacttatacattttcttaactattattactaaacctactacatgacaattcttacaataaagctaatgttaatcttcttcataattgtagattcctactcgacgcattggaccggaagttaggcatgtctactgtgaaggaaaccaagcggcgcacatactaacgcagtttgggagcaactgcaactcacatgctaacgccgagtgtggtgaacacttttggagcaaaccacctttatttgctttctttatttttcacaaagatttattagggactgtttcgatgagaccagtccggcactgtaataactctttactttaatacataataaatcagcgcccccatcgccttttattaaaaaaaaaaagaaaaactaatttttgttggacagtaataagcttgaatccaaacaagggtaacatggaattgatggaatcatttcttaatctttttgttcactcagagtgagatcatttttaaaacagtaagacaataacataaagtctaataaataaaaagggaaaagaaataaaaaaaaaaagaagaaaagaaaaaacaaaagaaggtgaagaaaaattctcacatcatttcatgtagtttaattttttgttaagtttatataagtaataataagaaaaagaaataaataaacgaaggaataacaagaaaagcataatttttaactcttccaatctgggaaagaagatcgatcaaggaataacctcaaatttgcatgcatcatggcctgtcaatagaaaataacaagcaataattaaattattttgtcaacatattatatattggcaatatatatattttagtctcaagcaagttgggtcgattatatgaatcttcacgatcataataaggtcagaccaacattatatggaacaaaccaaatactaaagagtgagttcttctatatctttttagaggcggatctaggatttcaagcttatgggttcggaattttaatcgtcttaagttattgggttctaaattaataatttatacatatttaatgaattttttaagacaagtataacgttcgaaccgaaactactagattcggccgaacccgctctcaccactctaacttcgccctagcttggattttcttctagcgtaaaaatctctactaggcctaaaaaactcctaaagagcatagagcctaaccgtgctaacacgaataacatatgctcgattaacaaatgttgattatatagatctttttattcaatcatgccctatctttctgtaaaaatatggaaaaaactagttcgtaacgggaggatcgtccaagtttatataaggagaccaacaacccattctttaatcaatatggttgaattctaaattaataaaatttattcatatacaataattttttaaaataactacatgattcgaactaaaactactgaattcgggccgaactcattctcaacactctaactccgcccttatagtttttctagcgtaaaaatctctaataagtctaaaaaactcctaaagagcgcagagcctaactgtggtaacatgactagaacatattccccattaattgatgttgactatatggatctttttattcaattatgccctatctttctgtaaagatatggaaaaagccagctcgtaaaaggaggactgtccaagtctattaaggagaccaacggcctattttttaactaatatgggactctatcccactctaatactcctcgcccagacaccgactggagcgtggacaatatatatcatagcacggaaaaggaccttactccgataccatgtaaagatacaatgcttggatcttactcaacccaaaagctacctcgtgagagaggattagcccatattttgcaaaatatagcagtgagatttcttttcaacttacttggatcacgagcagttaaaacagcagcagaattgaagtagcaacttgcccctttttgctttgattttggtagtagctattgaatgcataagaagcatgatctctcactgtatttgggaggtaacatggctgattttcttgtattttgctgcaatctgcaccattgccacatgcccaaataagtgcctgtaacagctcatcatctggtgtctgttcatcagctatgcaccaatcatgaaactgtccctctaaccaaaaaaacataaacaaaaaagacaaattcaattaataaacattcatttaaaggaggacagttgcggtagaccgacgatgagtaaaatatacagaagattcatatagcttaatcctaactagtttgtgattaaaccgtagttgactgatacagaaacgtgccttttttcccccactcttgagttgcacagccggaaacgacttttctatcttcaaaggcgctatctaatttatcgtcgtttaaggtttgctttactagcttccgcatgtcaattgattactcgatccaaaccataaagtaaggttaaggtcttcatacatactattctcccgggatctcacttgctgaaatacactgaatatgttgttgttgtagtcgtaatactcttgagtggcacagtactattaaatcccattgccaaatcttgacaggaaaaacagcgcaatggatctgaattcttggctaaaatgagatttataaggtctgatccactaaatgattggctatagttatgtgtctagatctagtcaaaacaagtcaagatagaaaatttcctaggtaaataattacatgtcaaattgaaagaaaaagatcaaattcttaccagattttaaggtaacatttgagatgaagatcaaaaagacaagaatctttatcaacccaaatgacattgatctgttgcaattagaactggacatgttcataacaatataacagaggagaaactctttgaattatatgattgtgcaaattattcaaatctgtgtacaatgacttaaaatggttgaaattttatttcatattgcctagtttgccctcatgtttattacataccaaatatttttatattaatacatgctataaaattctttattctttacttggaaaatatatttagtttaaagggttataattgtcaattgaataaaagatatgagattgtagcatatagtctttacggcatcaagatcaccgacttgagaagaaaatataaagcgaaaaaggtggaaaattcccctcttctcttctaggtgtgagttgtctagtgtaatggttaaggcacatttttaattaaaattaagatgaatcgatctgaatacacatttgaatattaatgaattaagaaagtttatatttttcaacatgtgaatatataaaaatatcaaagttaaaataactgattaatctaatattatatcaaaaaaaaaaaagtggtcagaggtggttacggctaatactagtgcttgcggttatgactgacgatagcagttgatggtgatgatggttgtggataaggggtgttcatggttcggtttgggtcggttttttccaaaaaagaaaccagatcaagtaagtcgatttttcaaatattggaaccaattcgaatcaattaagtcagttttttattgattcgatttttatcagtttttgtcggtttttcggttatttatcgattttttttttaaatatgggacatacactatcaaacgcatattccgacgactacattaatggttaaaggtggtggtagatggcggtagttagtatcgatggatgataattctgatggatgaaggtgatagataatagtgataggcaactcatagcggtggtcgacgctatatgatgatgactaatggcggtggttttggtaatgatagttggtggtgacgactgactgtaatgattgaccgtaatggtagttgtggtcttgtgatttatggtaattgatagtaatgggcgaaggcggtgagtagcggtgggagcggatggaatagtagtgaaatgtctttatttcagaaatcttcaaataattaacattttaataatataaagaactttgctttagatcttaattattcaaaactattcaaaccagttaagtgattttgaaataaaataaaaatacttaattattaagaccgaataatattaagtcctaaaataaatacacttaaaaactaaaatttaaatgattaaaattcttcactgcaaacaaatgagactttaaaatacattgtggatccattgggtccatgaagttgggccgtccaaattgagtatagcaagcccatattctaccttcaagcccaaaaataaaataaaagaacgcttcagaaaaatcccctgccgttcttcttcattttttggattgtccaccctccctcctccctcgccgttgcttcaaattttacaaagatttcaactttctttgtaaatacctcttttgggttttgggtatttgcttaatcatccaaatattaaaatctgttgaatttttatccaaaaaccatagtaatgaatggcagcaagaatctccattaaacacttaatcccattcacaatcccttctcatttatcaaaacgatcgctattctcttcatattcagcttctcatcaatccaaaactttggaatttctggattcttgtcaaagcttagctcagctctttcaaatccaagctcatttgataatcacggtcttttacaagtacagaatccttcattttcttgcagatttttgaatctctgtactcaacgttgtgatgttgaatatactgcttcggtatttaaatgcattgattttcctgatactttttcggttaatactgttataaaagcttatgcttgtagttctgtgccacatagtgctgttgtgttctatttcgaaaggcttaaaaatgggttcttgcctaatagttttacgttcccgcccctcatgagttcttgtggtaaggcgggtaatttggatttgggtcagaagtgtcatggacaattagtgaaaaatggtgttgatggagttttgcatgttcaaaattctttggtgcattgttatagttgttatgggtttattggtcttgctagacaggtgtttgatgaaatgccgcagagggatgctgtgtcttggaacagcattgtgaatggatatgtgaaagtgggtgaattagtggttgctaggcagttgtttgatgcaatgccggtgaggaatttagttgcgtggaatgtcatgatgaacgggtatttgaatttgaataaccctgggaagtgcctaaagttgttccgagaaatggcactgaggggattgaatgggaatgatgcaactgtagttattgtgcttactgcttgtgctcggtcagctcggatgaaagaaggaaaatctgttcacgggtctcttattaaggtatctaaagatttgaatttgatcactagtacgactttaatccatatgtatagtagatgcggaagagcagaaattgctcgtttaatttttgatcgatgtcggtcaagaatatagtctgctggaatgcaatgattttggggtattgcattcatgggaacccaaaagatgggcttagtctgtatgcagacttgctgagtagtagattacaaggtacagaaaaagatcatgttaagaacatgaagcaaggtgatggggatcgtgtgcttccagatgaaatcacatttgtgggtgtcttatgcgcttgtgcccgtgaaggactgttagcagaagcaagaacatactttggcgacatgagtgatttgtttggtataaagcccaattttgcacattattggtgcatggctaatcttctggcagatgttggcctaatgccagaggcaataaaaacactgaaggacataccagcgagaaagcaatttaccactggaatccgcattgtggtttgaattacttggctcagctcgctttggaagggatgtaagtttaggagaacaaattgcaaataagttgattgaggaagatcccaagaatttttggcattatctgttgcttgtcaacatatatgctgcagctggtcgttgggatgaagtagctcagacaaagaagaggatgaagaagagaggaatagaaagaacagcgggttgcagtttaaaagacttgaaggaaattgttgacaaatgacagagacataaactgcaggtatctttttgttaatctaacttgagacatcttttgtatgctaacagtctgatagcttttcagcatgatgtgcctgagtaggacgatgctgtataatcagcttccccactgttatcacttttgccctattattatcgctcttattactattgttaacagcaatgaagctattttaagaaatcgcatgatgctgtgctttgatggtcacctgatcttatcagagtcacagttcttgccgccagtagctggttattttacctatggaatagtctttgctttaaaggaaaatcctagttagatgcatgacctcaccctatatgttcaatcatatgatacatgttcataaagtttgtgtcctactttctgagaatatattagctgggaaccttggaaacagtctccctgcccttccagggtaggggtaaggctgcgtacatcctaccctcccagaccccacttgtgggattatactgggtggttgttgttgtatatcagctgggaacctaaaagtgatactgaagattgcgtgtgggcattcctttcactgttaaacttacttatttgggttacttccttcttttgtttcgttgtttggtaaactaatttttattcatcacttaagacattatcatctattttggtgaaatatgtagatattactggttaatggtgtgtctttattgtgcaggtattgaaaccttttttttgtggtacattttccaagtcgccagtgtttctacgaacaggcgcatatgtaagtggcctcttacattatgtaaaatttcgtgctattagtttgttgtagttttgaatggtaaaagattgaaaattcgagtgatcttttactcaattgatttgagcaatcttcttctctatgttcaataaaaaagaagaaattgattgaattagttacccttatcatatttatattttgtaagtgattacttgtccatctgaacatcagtttgagttgctgtcctcaagtaagaggaagagcaaatatactgtgtttttggttattaaatttaactactaaccctactcttttgtcaagtgttgcatctgtgctgaaagttccaattttgagtttgagtagacttggggcaaggacttccatattacagtctgatatcatcaaagtaacctttcttttttattttcattttttaaactggaggtaatcgaacagagctaggtatgcaggcttttaaccattttagcgtcaggaatttgaggagctagcttatgttgtggtgaatgcaacattgaagaaccggttagaccctcttttagtcttgcctccttttttaatcacaccaatcctgttaagtaagtaaccactacaagattaatgcttgactatttctctaagttaattcaccacaatcttggaaatcttgtcccaactttaaatgggtattccctatcttagaattcaaattctttgagcataattagatatcttactgctatcttctttgtttgtatatacagctgtctgtacttctttgatactttgggcgctaacaatgaagactttagaatgagtaacaagcagcttcggcgcaagctgttgatggatttatggcataactcctcgaaactgtccttacatcagaaggagctttgtaaaagctaaatatcatggtaaagactaagagttatgatggataagtaccttcgtgtatatgttttaatatatttgttcttatttgagatgtaataaattgtatattgtttacctttgagatctcaggatcctgcttactattcgtttcttctcagggaggctttcctcatgatttctttacacacttaatatctagtgctgtgcccttgtctgagaatgactcaaagtagagatatgtgcgttcatggtatgctttactggtaaactccaactccctgtttgcatctattgatgatgtttttctgttataacaatttaaaaccgcgctagacatgtagagctcatgatacttcacgaaaaaccccatcttcctattataacaatattaaactataaaactgcgtataaaaaacaatattcaactaaaagatgtgctttatgatctcaaatcttgacttttgtttgtacagttagcgaacgtgcaattaatattgaacttccctgttactctattgtacttggttaattttttatagatttatgattcacaaatgatgcagttgtgttttgttacgacatgcaggtatggaggctggaaatgacctctgcaccctctcaatgcatgcaatccttataaaccagaattggcgtgttagggtatgatactaataatcattatacatattattctaggtccagctgagatggtagatgatgtaactggtagattgaagcttttatagtggcagtcgccttgctctctttttgacattgagatgttataaagctttcaagatcctgagctagtgttgggcaagaaaacaccatagcaggtatctgggcatttcggctgctgcccagatacctgccacgttcttgttgctgctgctgatgaaacttgcagctcctctttaagctgcataacatattattgcactgaatgtccttacttagtttgacaacaaaacagcaaaagatggttcattaatttcttttaataagtcagaaatgggccattcattcgtagtgtattagtgagttacactgatgactgaatattgttgtacagtcaaacctccctataacagcctcgtttgtttcgaatattattggatgttataacgaattgttgttatagaaaacctatactataatagaacatgagatttggttccggaaaaatttggcttttatagagaagtgttgttatataaggatgctgttatagagaggtctgactgtatcttgatacacgagtatcgctctgtgtttatctgaaatgagactagaagattagtaacttaatccaataacaatggattgtgcatccccatggtttaggatttgaagggcataaaattggtgtgaaaatagaaggcataaagtttatgccttcaccgagttatcttgtcaaactggactccacaagattggtgtgagaataatcggaaaagggccaaaaatgtccttgaactatttgaaatagctcaaaaatatccttcctttatttttggcaccaaaatatttctaccgtctatgttttggaccacaaatgcttcttaaaccgttagtcttgccattaaagctgacattgcagtccaagtgagttagatttgcttacatggccatccacctaagcaatccagcatggcaaaattatttttccggaaatttttatcaaaatacaaaatcaatacttattttgaaaaaagtagtaaaaatttctggaacatgctttattatattgttcctgaaattttttacttttcttggaataagtgttcgaccatgaaaattttaaatttcacttgaagttgaattttcgaatttttgaaaatttgaaaactccaaaaattataagaatttcagatgaaccaatcgatacttacagtagatgtgtaccttttgtgaagctataacagataaacatctaaaaatttggatcaaactaatcctcaattcacaaaagagaacaatggagttttttaatcaaatcataaaccccaatcaagaataatttttccgaattttttttacttttttcggaataagtgttgattttgtattttaataaaaaaactttcgatataaaaaattattttgccatgctgggttgcttaggtggtgaccatgtaagcaaatctaacccagttggactgtcatgtcagctttaatagcaagactaacggtttaaggggcatttgtggtccaaaacatagacggcagggataattttggtaccaaaaataaatagaggatatttttgagctatttcaaatagttcaaggatatttttggccattcttcatatttaccacaaaacactgcaaccataatattttccttccttgaaaaatgttgcctttaatgttgttaatcataacctgggaaaatgtctatttcccaaccaacaacaatttaaaaactcaatggtataccacccagaaatcagaattcaaactcaccagatcaacgtcccttcgatatgtgtcatcatttgacgacttcacaatgttcttcctgatttaatttaaaaattgcgcttggttataaagcataatttgatgagcagagttaggaggtagctggtgaaatagtcgagcgcgccctaattttccaacctcgagaattgtgatagcgcctaacaccacacttgctaggtaagtcaatgttagaactcgtttaaccattttccttgaatatttatttaagcacaataatacaattaaaaataaactaagtctaatgaattccaacaaaaaatctcatgaataagataataacgaatgaataatcgaaccacgaactaataatatatatatatatatatataactctaagactacccaggatctggtgtcacaattcacgaactactaaagaatactacaaatactgggctgaaagaaaatagagtaactgttctgaatgtaataaaacaatgttcaaaaataggggaagactctcgggatctgcgaacgccgatagatatacctcgtgtctccgaaagagtgaatagctactactaaaaatctctactgctagctggtacctggatctgcacaaaagagtgcagagtgtagtatcagtacaaccgaccccatgtactgagtagtgccgagcctaaccttgacgaagtagtgacgaggctacgaaggacatttataacataatctgtgacaatatataataaagcaggaaaaaaaaatctaaactaaataaaagttataatctgcagcaataaatagagtaactcagccgcccttttttttcaagcctcaactataaccaaatcctcccacaagttttccaaatttttccaaatttctactttgaaacaaccgtaagtgcacgatatgaataatagtaaggtaaaacagtaagttttccaaatccttgtattcaaaaaacagtaaaacataaatgtcctcccttattgctccttgttgcggcccgcaacccgctcccacctatccacccttatttctcctgttgcgacgtgcaacccgatcccacctgtccatccttatcactccttgttgcggcgtgcaacccgctcccaccagacaatcacatctctttatttataaaaaggattttaacaatttaatatgcctcagcaattgtaaacaaaacaggtctttaatatgtctcaacaattgtaaactgaacaagtctcactttcaataacggtaagagcagaatatgaaataatgacaataaaacaatgagtgatccaacctttattttataaacagtaaaacatgaatattctcccttattgctccttgttgcggcgtgcaacccgatctcacctgtccacccttattgctcctccctatatatatcacccttatttctcctgttgcggcgtgcaactggatcccacctgtccatccttattactccttgttgcggcgtgcaacccgctcccaccagataatcacatttctttcagttattaagatttcacaattcagaccactacctttcacaacacttttgtttcaacaattgcaaacagaaatcagtatagctcgtaagctttaaccagtatcatttcacaataaaacccaccagaatatatgtaaacaccgtgacgctgtcaacccagctcagtctttatatactaggatagaatcaaaagaacaaccaacacttttaacacacttgcaataacagttggcaataatcaaataaaaccaagtagccacgtaaaactcaacaatcataaaacagttaaactgcatttctcataacttgctccatattataaaaaaaaaatgaaaccaacaggaatatacatatatatacgtctagtaaaacaatgtcaatctgctcaacctttatgtactacaaggaaaccaagaagacaactaatactcttccaacataattacaacaagacttaataacaaagtaacaaagccaagtaatcataaaaacaatagtgaacatagaaccattaagacataatcaattacattggaaatgagaaagggatcatgcttaacagacaatttggtggtgcatagatactcgtcacctcacctatacaccacacacatgcaattcacatagcaattaagttggggattcctattccctcaagtcaaggttaaacaagccttacctcaatttcgcaggccactcacagcctaattataacttttcctttagaatcttgctctaacttgctcgaatctattcataatcaacttattatcaattaagggtaaaggaactaactttattgaaaaatataattttttctaaattttctcaaaaaaaagtgaaaattcgaccctgggcccgcttggtctaaactcggggtttggaccaaattacgtttacccattcacccacgaacccaaatatataattagttttggaatccgacctcaattcgatgtaaaaatttgatttttacaaaattttctaattttatccaaaccctcaatttttaccatgaaaattcttagtttttgctttaaaagtgatgaaaaacagtaaggaattgaaagagcaaagtttagaattgattacctatgacttgaggatgatatttgatgaagaaattcgctcctaggctgtgggttcaaaaatatgaagaagaggaatgtctgcccgtttttacactgtatttataagactgggaacttactctatgcattcgcgtgcctttggccacgttcgcataggcttagtccccctaagcctaaataactctatgcgttcgcatctgtagggtgcgttcgtatagaacaaaataatcccccagtatttttactctatgcgttcgcatctgtagggtgtgatcgcatagaacaaaataatcccctagcatttttgctctatgcgttcgcatcagtagggtgcgttcgcatagaacaaaatgatccccagcatttttactctatgcgttcacgtctaggggggtgcgtccgcatagaacaaaattatctcccaacatttttactctatgcgttcgcattcgaaggggtgcaaacgcaatgcattaaatagctgtgcaccaacaacaacaattacaacagatgtttaagtgaaaaatcatcccgtggtctatccaaaactcactcgagccctcggggctctaaacaaaacatgcacgcaagtctaaaaacatcatacggacttgctcgtgcaatcaaatcatgaaaataacatgtaaaacaatgaattacacctcaaaactcatcattttcatcaagaacatttataattcataacttttcaaccaaatgtccgaatcacgtcaaatgaactccgttttttcaccaaatttcatagttatcctttttatatcataacatctgtaccgggctccggaactaaaatatgggcccgataccattgatttcaaacaatatttcttttctttatttcattaatatttcagcaaaacaatttccttcaaaaattaatttctaaggctcgggacctcggaattcattttcgggcatacgctcgagtaccatattttactgcggacctcccgggatcgtcggaacacagatccggatccgtttactcaaagtgttgaccaaagtcaactataatcaaattttaactttagaaattactatttctcatattttcacataaaagcttttcggtttcacccccggactatgcacgcaaattgaggtattttaaatttatctttttttggggctattaaacctaaaatggagtctaaattcataaaataaccccttgagttatcacagaaagagatacctttggagatgtgattgaacttttggttggcatcttcttcattgctaataataatttgattgaaaagattagttttttttttgtatttgcaacggatttcttcttcaccttttgttctttggagcagaaatactatttgctaattttacctcattcttcttcttcatctttctttgaatgctagggattcttcttcatcacagactgaattacccgtctggtgatatacctctcccaccattgggtctgcttctattttttacttcttttcttcttcccttttttggcggaatacatccagagtcccttaaatttgtcaatatattttatctaaacatttaaaatattaatgcatattacaatgatgcatatgaaaacataataaaatattcctaccataaaatttaaggattacaggtggatagtgatgacagggtggagataagtcaacaaatagttaatatcagatacaaacacgttactggtattgtacgaattttgaggacataaagatcgaagaagtgaatttgaaagtaagataacggttagagaaaacaacattaaaggacttgcaggcatgaaatgcagcgtccccgacaaaaagggacgtcagaaataatgtaccggatgtaaggcacagaatgaaggcaacagaataactgaaagttgaaactgaactgataatataataactggaagtaacatggagtcaaagataatctgaagatacgcttacctgctgatactgactcaacctctcaatatagtacgtaaaatagttgtccggccttataaggctcggtatgtgtaacaactcaatcgtagtaggctcattcataggcgctcaaccatactaggtctgtatctcggccattctgggctcgttcataggcgctcggccatagtaggctcggtatataactcactatctaatcagagttttcccaataggggcctgcccatcgattatagcttgatggtggtgaaaatactgtaatactgtgcatatatagattctctactcttttggctgacagaagacaaaactaaactgaaatgaagtcccgataagggagaatactgtaaattatgagactaggacaatgtacataaattcagaaatatgaacttctctttatgtctcgttatcaaacacatgtagttactagatcatgccaaaggaaaagtttagccttaacataccttaactttgttgagttcttaataccttctaagcaatttttctaacaactcaactcaatctaccacagtataaggagattcaaaatcagtgctgagtaaaggctaagttcgcaacttaaactagtagctcgtttatgtaaatttgggcaacatctccctataacaaggccctcatccaataccatataccaaaaacaccaagaacaaaacaataacaacatgtatgtatctttttccaaccttatctccatcacaatatatcacaaaatagcccacacactataatcacttcatacataaaacgacaaaaagtagtgtcaaacaacctaaaaagtaaacgacgaatgaccaccaccattccatcattatgaggtgtttctcccaccctttatcctccaaaactccataaaacatcagcaaatagacagcccaaaagcaacacgaaacaacccacaaaaagtccactacaagtcgaataactcgaactcacggcttccgatcatcgtcccgtgagttctaactattaggaaataaatttatcaaccttcctatgatttaaagcttaaatacagaaagtagacattttcttaactatgaagtaccttccaaaactcaaactacaaagaaaaagaaaggcgacatatcgatacttacgtcgtagggatcgttctagtattaatcgcttcttgatttcgtacccgggatgttaatattcttgaaaaccctcgtggagagcttgaggataagtttaggggtcttattctggtcgtggtatatggaaaagtgaagaaagagacgacataaggctataatataatatatattatatatccatttttgaaaagtccaagaggtactagcttggcaccctattattggctcttcttcaggcgcttatatcattttatccgaatgtcgtatgaaagaacggttaagagagttagaaaatgcattccaagaccttccatttgttatataatatgtctctaaaatacctcatataacacatgaaatgtattgctcaaaaagctttagtgacacacctactcgtcatttatgcagtctgcgcagtctcacgaagttgcaaatatctctctactcctatgtcgtatcgatgaacgatttaatgcattaaaaaatagactcgtagatatcaatttggtaggtatatcatctcctaattccaagtatattgggagaaaaactcagctacatttgacctaagtttatcataatttatgaatgtaacttgtgatgatctttgccaacttttgttccacaactcgcttgacttcaaaacataacacacgattatcataagacaaaaataattcataacataacctccttatcattttgagcaccctagtctcaccttaaagtacatgttataatattcccaacttgtcgactttcgacgaaacttattttattcaattggtttagcttctaagccttccaaccctcttggtacttgcaatctgtgatcttaatatttgtaacctccaagttaacatgattaacttactttctatactttcaacgatgatcccatttcagagcttacatcaattgacttacaacgtactctcacacacgaaactatggggtgtaacacaaaatcatcaacgtataccagctgatcaggtggtggtgcgtatataaataccgtaatatatacacacacacacaccatacacacacacacatatatatcaaacacaccacacacacacacacatatattatatatatatatataacgccatctggtcatgggtaaatgtacatgtataaatgaatgcaatgaatgagaagtacgtcaataaaatctcttggaacgtcataagaccattatgcctttgattaatgtcatgaagtaaactttatcaacttacgtatttttcggagacccatgaacaggtaatagaataataggacacatggagaatcaggaacataggcagctctagtatttctatgagtagagtcatttatggaagttgtgcagttgctcgtttcctttgtatcgtatcgatcataccaaaaagaaagaagggatagccttaacatacctgagccgattctcttgacaattcctctaacatacgtcaattgcgacaaaacacgtaacgacggatcgaagtaagggagaatccgtatgatatcttgagaaaaattgtaccgtactcccttagaatcgcaaaatcccgtttctattatgctaagaagtctcgtatgaatctgttgctgaagctatttacgttgatatgaagataggtatatctctcttttgtgaattttatcataatctcatataacttttgttgaatttgagaagactttcatgtcttttgttgaagttaaacgttgccttccatatctttgtgaatttgagagtctttcactttagtgggtgtgggcccaactaggtgatgacttagccagagctcatccaaaatgtgccaccttgttttgtgagttaagactcattatcaaggcctctttgggctgtcatggtggggggggggggggtgggtttaaacttatccaaaaattcaccctttccttaattaatttattaatcatccactaatccaataattactcacataattaataattatctcaaattacttaaaatactacttacttttaacatggttatgtggtaccctgtatgacactagtccataaatacggggtattatagcctggaccgtattttagttcaaatattgaacttcgacgaaactcattttctttgatttgcttaccctcttaccttcatgaatttacttatctcttgtttgaaatatcataatacttataacctcaaactaatctcattcctgagcttgcgtcgattaacttacgatgaaactttaacgtacgaaaatacggatgtaaatttcatttctgagctttcatcaatttacttatggcatacttttacgtacgaaaacatggggtgtaacaaaggtgtaggtaggggtgatggattgggggggtggggtgggggtgggttagtgggttagtggggatggagaatatggtggagaaggttaaaaaagagttttggaaaatgttttcccttcttctgatagggaaaatattttctccaattaaggaaaataagtttatgaggaaaatatttaaccaaccaaacatgaaaaaattggaaaatatttctgaaaaatattttctttcatacaaacacaccttcatcatgggtattttaaatggatagtttttagaaatatgtaattatttggataaaaaaggttaaaaagtaatttatttaattcaaacaagtaagtcaaaacaattggtgatacggtaagcaggaaagcttagttaggattttaagaaatttgtgagataacatactttacaaaatatgaaattgtaaacacattttgaagtaaaaagttaattattatttttccgaaatccattaataaaataataactactactattttttacgcacataaagctgcacaacaaaagtttaaggagaaataaaaaatttaaaagaaaaaaggaaaaaaacctagctgctgacgtggagcattaactcgaggcacatcagaaaccctagatgccaattatttataaagtaagcagacattgtactttactttggaacttagtaattttaaatttcataggtgaaataaaatctgatttcatgacattggctattgttcaactacatggttgaaaagtggctatttatgaattttatcctattaaaaaacgggagaaattcaaaaatagccagatttacaagtggtcattcaaaaatagtcaagctttcaaaagtaatcgaaatttagccatttttcatataaagataaatctgagcaaaaacactgttcaaaacacagaaaatacgccagtatattatgctgaagttccagtacaagtatacgggaactccagcataatataatggagttctaacataagtacactagaactccagaataatatactagagttccagcaaagtataccggtccagtataatatgctggaagttcatacacaagtgctcgaatctccagtatattatgctggaactttccgtgtgttggagttccagcataatatgctggaaattcatatacaggtgcaccgagctctagtatattatgctagaccggtctctgttgcagcaaaatagtagctatttttcaatgacttgacaaatactgactatttttgaatgatcagtccagaaaactggcccgtccgtgctatttttacttaaaaaaattttccttgattctgttttgcctatatagcgtgagttagccatttatcattgaatttaaagtgaaatctgaaacttgattacattggttaatttttcaatttcacggggttaaaaagtggttattggataattttatcctattaaaagaactccctaaattttggtcaaaacccacacgaccgaactgcacatactaaaattaaccagcctgcaatcccaaacccatatctcattaccctaaaaacatcgacacatttaatcctaaaagccttaggtaaacttttattcaaagatgcgtgaggcaaggttgagatgcgtgaggcaaggttgagatggttctaaatagtattgatttggtacccagctgacaaaaaaaccgtaataatatgataattaacacttgacaaaagatataaaacctgcatcacgcattaatcgcgtgatcatcaacctcattcgtgagaaaagatctccccctcctctcaacagctttataaaaaactagaaacttatccggattcatcttcagaatcacacttgcatgaagttgtttcacgttgaatctaaatcgtcatgctaatgtaccatgaagttgtttcatgttgaagctaaaacttcatgttaatatagcatgaagttgtttcacatagacgcaagcactttatgctaatgtatgctgaagttattattcctgtagtctacagttttgtcatgagttttatccgaagcttcaatttaaacatgctgaagttatttagttcatttgctaaaacaacataataaacatgctgaagttaattagttcttttgctaaaactttagaataaacatgcttaaactttttagttcatttgctaaaacttcagacaaacatgcataagttttttagtacatttgctaaaacttcagactaaacttgcttaagtttttttgttcatttgctaaaacttcaaattaaacatgcttaagttttgtcttgcagtatgtaattatctaatgagtttttgctaatgcaggctaaagttattcagtttatttgctaaaacttcagacaaaacatgctgaagttatttagttcatttgctaaaactttagactaagcatgtttaagttgtttagttcatttgctaaaactgcagactaaacatgcttaagtttttgtcttgcaatatgtaattatctaatgagtttttgctaatgcaggctgaagttatttagttcatttgctataacttcagacaaaacatgctgaagttatttagttcatttgctaaaacttcagactaaacatgtttaagttgtttagttcatttgctaaaactgcagactaaacatgcttaagtttttgtcttgcagtatgtaattttctaaagagttttttttaatgcatactgaagttatttagttcatttgctaacttcatatcaaaacatgctgaagttttgtagcgcagtctacagttttgtcctgagttttatccaaaacttcagtctaaacaaactgaacttttttagttcatttgcaaaatttcagcttaaacatgctcaagtttttgtcttacagtttgtcaatagtttttattaaagaagtccaaaatcgtgttttaaaacgcttttaacaaaaaaaaaagagtacaaatgcaaacaaaaaaacaaacgagtataagttaaaaaggaacgaccaaatagaacgccccatgcaatttttagtgctttacacgaagaactctatataagttccatcatacatgaaataattgtcacgacgctaatatcattttgcttaattaccaaataccaactttaattgcttatcgcctttgtccattttaagtcaaaattattccaccgtgcattggtcccatttccacattaagcaaatcaattaaaacattagttagagttgctatttatgatacaatcagtcaattataaggttttaaacttctaataattaatgttatcaagctctttatgacttgagcaaagatggccaagcgcgcgctctctatatatatatctaatctcccgacacgtgcgttgacgtgcatatgaagtcaattatatatgaaagtatatagtaaagttcttgtaaatgatcaatggatctatcgtatacgccttttgataatacttaagaataatacaagctaataccaacatattagtatgagaagtttatttacaacaccccttaatatttagctaaacaaataataacaaagaattgacttatacttgtagaatagattgcattgatgctttttttgattgaataattgtgttcatttataattataggtagataatatgtgataaaaaaaaaaaaataaaagtattagacacattacttttttttttactagtttttcaaaatatgtataatatcacgcattagtcatatagcgatacgcgatacgtgtcattgacttaaaaaataaaaaagaaaaagaaaaacaaaccccgccccggaaaaagaaaagaaaagaagtaaaaacgaaaaggaactcatctccttcctcgtgccttcacagtccccccaccactactctttcatcaacaatcttctttctccattaacatacacatatccaagaaaaaatcatggttagactaaaaatataacccagttttcaccctcccaccattattactcactttctacagcctttttgttatctccattgccgtcgagcacaaaaagaacccaaacctccaccttataattggtaaaaaataaaggagaaaccctaatcgattgctcctaccttctgatgtatttttttatgaaagtttttaagatataattcgtaggtgttttcatggctgccccattgaaaagggaaaaaaaagaaattcttttacattgttctctcaatctcacttgaagatttcattactatattgtttataatttcttcctgaatcgattgtttcatctgttacaatttgaacagatttcttcattgaaagtggaaaaaatggatacaagaatactttagaaaaattaaaaaaaggatgacattagaaaaggacaaaaaaatctatttaatcattggataagttatgttaaatctggacccttcaaataaataattagatatacaatttttactgttcagacactttattttgtttgtaaaacacgcacatgccacgtagacaaagaggtatgtcttaggcatattctaaaaaggtgaagtatgtaaggtgattttcgtccgtaaaaaaaagtgtaatagagatttagtccatagttcagtgagaaacatttgtattttaccataaaaaatctcattaccaactttgttggccaggtatatggtgatgacattgtaaagaagttttatgctaccaatttatttttatttatcgcaccacataactactctaattctcaggttattaattacatttttatggactattaattatttaattgtaatgatcaatagataacttgatagtgtaaaatttcgtttaaaattgcatattaatggcggagctaggaggaggaaaaggggttcaatattcccttcattgaaaaattataatccataaataggttaaaaattcctaagccttattatgcagatcaaagagcaattttaattatataaattgttgaattcctttaatataaaaaatataatgaaatggcaaaaggtattccaaaattatttcgcgtcaaaggttcaaatatcatatatgacattctataagttttcgaatctcattaaataaatttctcgcttcgcccctactatcaatatataaaagttaaacttcaagaccaaatcatcctattaccaactttattggtgacaaaacccccatacattgcgcttccattttttttttaaagaattacaagaaaatatacgtgacttcacactataataaaaaatgattcatgtttttaagttttatccgacctagcctatattatacatattttaaaagcaatagcaaattaaaaatttgtattcttacaatcatttctttcactctctcttcttctcgtatcttctacatatgcttcaaggggtcgtcctccactactgcttctcctccatatgtcacttggttgcaatgtatgaaaattaaatattagaagtccaccatttaaggccattcaaagctttgctttcgaaaataagattttgttgagtttgttagttatttggattgggtgttgttccaattgattgaaaatattaaaatgagttcacaatttaaatttgaaatgatttggagcagatttgagttgaatttcagaaaagatgcaaggaagaagatgaagtcagttttttggataattatgtataatcttgtataatagtgtatatgagtgtataaacacgtgtgtatgagtgtataaacacatcttatacactattacacattttatacacctttatacaagcgtctgtagacgaactccttccacgatttttagttacaattcttgttcaaaaccagttcaaatctccattaaatgacttcaaattttatatacaacctctatactacttctaacaagtctaaataacaccctgctccaaatttttcacaaaatcaaattcgaaatttaaattcacatatttatgcttgttaaaaatcttattttaccaccccaaacagattcggtttgttgaactaatatttgagttacagttatgattcaaaaattaatttaaaagcttgagcaatcttttttaaaaattgaataataattttcagaacctattggagttgaatgctgaatattaacctattatttttgggaagttagctgtaaattaaatatgggctataaaattaaaaagtaagaaccccaataattcttatgtgaaattttcccttttttttaactctttcttcaaggccaaaatatccaataaaatactgttaataatggagtcatttctaacatgataattgaactagaaaaaaggggaaaaaaagttaaagcaacattctatcatcaaaaactagcatctgcagctttcttttctgcatgccactctcatccaataacttgaagacaaattaattaacacccccatctttcggggtgattataattttcaggtctcggattcatctgaatctattacttttcatgcagaggataaattcaatgcgtaaaaatttattataattacaataaatacgtagtaaatattattggatttaattttagtttagtttaaaagagggtgaataaaaaatgaaggtaaaaataaaattttaattttccttccttgacaaagtgacattgtcccgtattagaagaggaaaagacttttaatgagtatagatacaattgctgttcttttagcttttaaagagttaagaagaaggcaatcctcgcgccgtcgtcgtcgctcggcttcggcttctgtcaaatgattgattgattaatttttagaccaaatttatttgttaacgcaatattattttaattcaaattagtcgtttttgtaacggtaaactaattttcctccgcgtttttgatttcccgttttgttttacgtaagtagccatttacgtaatagtcgtttttacgcaaacagtcactctgaagagttgcacatctttatttaaacccaactgttcactataatagcagaccattccctcagattttccgtacgaaattttctgaattctcctcttcctatctacattgttttcttacaaaacaaataaacataagtgtgatttgctgccgccatttgtgttagttgaaacattggggtttgaagtaccgctacaccagtgtgtaacccattctatcttgggaggaaataatcacaactttgagtactaggaggggattaagttccttaagaaaacattgtgaagtcagtgaggtcagattaaattctatttcttctacatttctgtttatacgttatttttccttctccaaatttattttacatatacattataataaaaaatataaacttataattttaaaaaaatataacgagttgaatggaacccattgaattaaaatattggaaaaggctatgccctccttagggaaggggaataagattggaaagaatgttggtttgattttgtatcaaagcgagaagctatatatataatgatatatatatatatatataaatatatatataatatataataatatatatatatatattaaatatatatatataattttagaaaagattgtatcatggttaaaagaatcatgacctaggattattcccattttatatgattgttttcttctagtttcttttcctctccttctcctccaaacactaccttccaacttaaaaacaactagaaaaaatttcagaaagagaaataatattctccctttcattttatatggcgcggggtgtttgattagacacaaaattttaaaaaaaatatttttttatatttattaccttatatgtcattacatttttatggtgataaatacttatctaactaaaataaaattttaaaattaaattaaattatgggttattttctttaatttcgaatagatttaaaaaaaacagtgtcatatataagatgaaaacaattaaataattaacctcaaaatcggttttgacatgcctaaacaataacaatagcacgaatcctaagttacggcacgtgaaggaatatgactccacacaaatcatggacggatcttaacaaatttctcaggactacggtcagatctctctataacaacatctctatttagtaacagttctctataaaagccaagcttttttggaaccaatttttatgttatgttataatatatgttctccacaacagtacttagctataactaggggtgttcaaacacaaccggaaaaccgcaccaaaccgaaaaccaaaccaaacccattaaaaaatccgactaggttttgtttgacttggtttggtattgagtaaaaaaacccaaaccaaaccgacatataaatataaatttttagtatatatttttaagactttatattgaattttctttaaaagattgaaaatatttgggatcctctcatgtgttaaccttgaaagcgtacattaacgaatattattgttagacgactaagaaaataactatcatgtattaataaaaaaattctcccattagaatattttaatagatcatatgtttgttaattttttcaatgtttactaaacgtaaattcacttctcaaaactttatctataactttaacaaagtaagattagaataattttcatgtaaaaaaaaacccaaaaaacccgacctaaccgaaccaatccaaaccgatatagttggtttgatttggttttgataaaaaccaaaccaatttggtctatgtacacccctagctacaatattcaaaaatattcgaaacaataaagccgttatagagagttttgactgtacagacgctccggtcagaacatggaaggtgtataatttaagattaagaaaaggaaaaaaattataaaggtttgatgagcacccaaattaaagggcaccatcttctccaaaggtaaaagaggagcctttggggggacaatatagacagagcatcaacacaacctattattcctccaaacacacaattccatgtgctactttcaatctgttttttggagttttctttttactcttttactctttagctccactttggcctctcacacaatcaaacaaaactactactccttagattggatattcacatccttttccttttggactttgtgtttctttgttgattcttcttttaatttcttcatttaaatcatatactacctctaaaaaacaactttaaaatgaccaaaatatccctacccaactttccaaataaatacatacccatgcagcttaaaaactcatcccacgtacaaaaatattctactagtttttagcacaaataaatattcttatcaaaatggccgtttgttcctctattgctttgttgcaagaaaggtttaaacaattggaaaagtgaaagagatgaggcaggagaaagagttcttgaaaatactatcttcttctactattattactcattcaatcggatctgatcgtagtttcgagtttgataatcatcatcagtctgaaagatcaatattatctcatagttatgctcaatatcaccatcatcatcatcccattactatggaaatgcataacaatattgatcatcattatcttcagccactcaataatcataaaaaaaattcctacaaaaccctaagccatcatatgatcaagtttctctttctctatggccagaagctcattcgcagactatgaacaagttttgatggttccattcagatgttgatacttctcttcatctttgaacctgggggaagagagagagggagagagtttggtatatagcacctgtgataaagtttgcgatcatattatctaaaaatttattgttgttgaaaatgtatttttatttatttaattataatttcaacacgctcatctagctgcgccatggaacttaaaaataaaatacagaaaagggggaattgtatgcttttatatactatattaacaggttatgaaatcatgcatgcgtggcatcaaatcttcatatatatatatatccagaaacacacatgatagtgggctgcataaaacttgcctatgtagcaaaaattagatttacaataattacactacaccttttgatcatagcaaattaacctaatgagctaaatagggttaaaacttaaaagaaaaatggttctttaagagggttttgctggcattactgtgttcaaaatcagaaaatcagagaagcaaacaaacattagttcaataaacaaaattgggaaataatttcgagctcactaaattcatagtatgtccataagaaatttaatcccctcactgttgcccaaggtatacggattaattccttgaggatagaacgaaataactattctgtgatagcggcacttcaaatcacacaacttcacgaactcaacaaagagcaaatcaacttgacacttatgtttatttagaaaataatgcaacaagtagaaaagagggagagatttcagattttccttatttaaaaataaggccaagccttaaatttatagacaatgaaaagggtagatgaagaggtgcaatccaagaggtcctcttccatttcccattcacacccttaataaaaacgcaacaatccccacatgaatggggaatggacatatgtgaaaaacatgcatgaaaatactgtgtgattcgcaataaggattaatcgcatctggataagtaggtttccctttgaactttcgtagtgaacttatgtcggatatactcggtcaatcggtagatttgatatctttgaaccgtcgagctttggtgtatacctagacaaccataagtcacacaatcaatccttaaccgtctttggttctcacggttgtgttcgtttcagccatgaacaccgctggtttcatgagtgcttagagaatgggcctttactttcattccccttaaagcggttacacttcacactcacataggtgatttctaaacgtgtaatcctatagacacactatctggtcatatcctgccagacttagcaaatcattaaaaagctttaagctttattgactcatcaaaaagccttaatgctttaccttgatttctgaacattgtcttcatcacgagaatgggttgagttatttgacaatgttgaaccgtcattcataactttgtttgatctctttgaacctagctcttgggatctccagtctgctaggtagagttaccgccatgatgacttgtcctaggccttagccccattccttcgatgatctttcaactgcctctctagataggccttttgtaagtggatccaacacgttatctcttgactttacgtagtcaatctgtataacccactagagagtagttgtctaagtattgtgtctccgtcgaatgtgacgaattttcgttatacataacgctcccctgcctattgccgcttgactatcacaatgtatacatataggtgccaaagtttgggccaaaatggaatatcttccaagaaattcggagccattcagcttcttcaccggccttgtctaaggctataaactcagcctccactgtagagtggtcaatgcacatttgtttggacgattttaagacatcgctcctccccgactgtttagaatcgttgaaccagtatctaatttgcatcactatacccctttattatccggatacttattgtagtgcaaagcataatttggagtatatttcaaatacttcaaaactcgtttcattgcataaattcaatgcaaactttcttatgtcgtagactaatacgtatcgactttcgattgaatatcaaattattgactacactaaatgtatcaatcgtatattataaaacatctggaatgattggcatcagttgtggccataattttttaatataaaacgcatttcacaatcactccgtcattttcaagcaattgtatgatatttatatataagtctatatgatatgcatattatatcactttcattcatgaaacaaatccaacttgtaatagactttcgtcatgttcatctgttggttcacctaattatagaccaacgtattaatgcgttcgttcatgaacagtcatgtttatacaaaatatacaaatgcattttcacgaaaagtcgcaaccttcgaagtgacattctttcataaacgggctaaacaatataaattttcaagaaagaaacaaccttttgagaaaggcaagtgaccaatttctgaattggtagtttcactcaactagtcttcactaagactgaataaataatgagtttaccaactaccatatttatttccactatttatacgaatatagacatcatgtctaatattggcttctgtcatgcataagctaaatgccccactttcaattatcttatgccttttctattattcgttatccacatatcatccacatgacaatattaattgatcaaattttgcatgtcattgtttgggtgcttgttttactccgtaaagtgacttaacaagtcaaagcaccttctttctttttcaggaaccacaaactattggttgttccatgtgaatttcttcctccaaataacaatttaaaaagggtgtcttcacatccatttgatggatttcaagaccgtatactgttgccaatactactaacattcatatgtatgcaatactcgtaaccgatgagtatatgtcaaaatagtgaagatattctcattatctcaaccatttggctaataatcttgccaactatttgtcaatagtaccatcaactttcattttccttctgaaaatcctcttagaacccaaaggtttatttcctggaggaagatcaatcattttcccaagtatgattacttaatatggattctgtctcactattgactgcttctttcgaggaaaataacacttcaaagtttgaagttcattttctaacaagtatgtcaaaaaatctggtccaaaggaagcagttgtcttttgacgttactacatcttagattcacctcgttaggtgtacttccctttgcttcttcccgaggccgcttagatatttcactagatgactcacattcgtctttatataaggataaatattctcaaagaattcagcattatctgattcgattaccgtattaatatgaatgtcgagatttttttatttcagaatcagaaaacaatatccttactatttgttgcatatcttatgaaaacggacgcaacggttttcgatacgatttttatccttttgggtttaagaacttgcactttacccaaataccccgcacacttggaaatatttcaagttaggttttcttcctttccatttttcatatagaatgaattgtgtcttgctatgggaacgcgaatgcgtattcaattagctgtaagcatagcttccccctacaagttttgggtaaaccagaacttatcaactaggtattcatcgtctttttgacgctctattctttctttctgcaattccattagattgtggtgagtaatgggcggtttttggtgaataatttcgtattccaaccaaatttcttcaaaaggagattcatattcaacgtccctattacgttgttgagccaaccacaagaactgttgtttgtgtcacaacagagccagaattaataaatgctgaagtttttaatcttcaaaccaatttgacctattcagaattaataaacggtgaagtttttaatcttcaaatcgaataatatgtgacacaatcaaatttaataaatgatgaagtttttaatcttcaaaccgaataataaattagagtagaaaattactaagattttaatctccaaaatccgacaaatgagtagaaagtcgtgaagactttaatctcaacgaacgagtgaaaaatcacgcagattttgttctcaaagcaggagtagaaaatcacgaagattttattctccataacatgtgtagaaaatcatgagaattttaattctccttctaaatagttttccaactaaacaattacaacccttaatatttcaacagtttgatatattatattgttcttatcaactaatatatgtatatccatataaaatagtatctctatgatcccaaaataattttcaagtaaagatgtatgtctaattcatatcttcaaccttgaaaaattatctctcacataattatacatgctaccaaattaatatacttcctccgttctaatttatgtgaacatatttgactgggcacgaagtttaagaaaaaatgaagacttttgaaatttatggacctaaacaactcaaaaaaggccccagagtatttgggtggttataaaagcttctcattaagggtagaattgtaactttaaactaaattattaccaaatttagaaaaggatcattctttttggaaggaccaaaaggaaataagttcacataaactagaacaaagggagtaccaattaatcaaattttatagcatgcaaatatactttgagatcaatctaccctaacatttattgaaactaaatttcaaaaatcatataggcagataattaaagaattagtagactaaagaagtagaacccatttttgccagtttcttctttgccaaaacgcaatacaactctattaaccactgtctgtcgtacggcaatccgcgacaaaaagattctctgcctcacaatacctttcgattttactgtgttcaaaatcagaaaatcatagaagcaaacaaacgttagttcaataaataaaattttaaaataattccaagcccactgaattcacagtgtgttcttaaggaatttaatttcttcactattgcccaaggtatacggattagtttctccaggatagaacgaaataactattctgtgatagatgtacttcaaatcacagaacttcagcgaactcaacaaacggaccaaatcacacttgacacttatatttttttagaaaacaatacaacaaagtagaaaagaggggagatggttttagattttccttatttgaaaaataaggccaagtctctaaatttatagacaatgaaagtgtgagatgagaaggtgcaatccaagagatacctcttccgtttcccattcacgccctttaataaaagcgcaacagatttcatgcaccttattagactaatctttccccattatttcttttcctttttttctcattggatcataagattatggtagaagagtagggattatttgagacttgtattagcagatttacttactttcatgttgaagcacttttaacctcgatcgttcaaatcctttttccttttttcccctagtctcccgaaagaattagggtaagattacgtacgatagatccttatggtccgaccttttacatttcacgcatagcgaaagcttagtgtatcgagctaccctttgtttccttcttctttccatttaatttgagtgtattaacaagtataaaagtggacatgaacaaaagaaataggaccgtgagataagttcacataggaggagtaatttaaataaaatgaacactaatttttgtcatttctaggatgaatttatttgtatttaaatacgagatttttgtatacttgtctacagtccacgttactataagagtaaaacttaaaatcaacatgttaagcgcgtcattgaaatttctgtttattaaattatcagaaaaatcgagttaaaaatgttgattcagatgctcaaaaactggtatactgacaaatacaatataataagtagataatgcgagattcaccgtccggccatgaccattcctcctttttggcatttgggccataatacgaaaattaggttcgactttatatttttgtgtgctatagtctacgccttccgcgtggacccgagccctggatacgaaggaccatcgtacaattagctaaggtcaagtgttaattcagttgctctctctccttttcttttcattcttttgttgggccaaacaaaatttgtggtttaaaaatatgtgaaattcaaaaataattagattataagtggtcattcaaaaatagtcacactttcaaaagtaatcgaaatttagccacttgttatgtaaagataaatctgaacaaaacactgttcaaaattcaaaaaattctccagtatattatactggagtaccaacataagcatactgaaactccaacatattatagtggagttctagcataagtatactggaactccaaaatataatggagttccagcataaatatactagagctccagtattatatactagagttttagcaaaatataccggttcagcataatatgctgtaagttcatacaacagatgctcgaatctctaatatattatgctggaacttttcgcgtgttggagatccaacataatatgctggaagttcatatacaagtgcaacgtactccaatatattatgctggaccggtctctgttgcagtaaaatagtggctatttttcaatggcggaaaacgctgactatttttgaatgaccagtccgaaaactggctagcctgtactatttttactttaaaaataggccttctttttatggtcttctaactggacctcaacgggttagccaagattggatccttgtttggcccaaccaaatttttaaggtttttccgggaaaagttttgatagtcattctttctctctttttctattatcttattgtaatttatgttttgactgtggcagtttaacgtgcaaaagcttttaatattcacacatctaagctttagtgtatttaacattctcgtatcttagtattcattttagaatgttgttttcatttcttgaaaaagaattacacttaagtaaatgtgattaatattatagacaataaattgcgttgaaaaaattaaaatcaagaccgaaaatatcgcaacaattgtagtattttatttcaaatatttgagtgtacaatctctacgaatcctctgattcttccttccgatagtaaataaattcgagggcctttgagcttgatcatgaatatgtagttgttaccacgaacgatgatcttgttcttgttctttagcttgattgcttgaccttgaccttgatttgttcttcgttcttgagcttgaacttgattgcttgaagcttgaaacttgtagagaaatttgcggtgtttgatccacgagctctctcttgcttctgttataacttgtggtgtcttttctgagttatgaaaacccctatttatagttgtggggagggaagagttatgataaaaaacaaactctttccggccaatcaaattgaagtgtgacatggccgtatttgattggccaaaacatgtcacttgcacacgtggcgcgatttcattggccttttaatgtgacttgacatgctttgtcattttgacacgtgacacgaccctattggctcttccgcttggcttggcatgccatgtcatttgacacatggcactaaactgagcctttaggaagatgacatcttgggcttaatgaaatggctcatcactttaaccccaattaaatgggctagcccaatggattaagacttatttatttaatctatatatattgaacttatataattaattcaattatattagtccataatatttatttggactaatatatttaagatattatccaaattatcatataaatataaatttaatgaaatttgcatgtctacaattattgtcagcatgaaaaacctaaaatcagtgatgaggtagcttattagctattgtttcaattagggtggcaatttcagcccaaattcattcaacccgcctaactcgtccggagataaatgggttgggttacaaacattttagttcatgggtcaatatgagctgagcccaagttaaccattaatttttataacccattctgacatattaagcagcccaaatacaacccatgaaacttacccaaaccaaagggatctcaacccaactatctagaaatttacttagttgcctaaatttcacttatttttcgtatttttaattttctgcaccacccacccacccctactccctaccaccaccaccaccaccccaggcgcataaacccccaaaaagaaattacttttttttttgtatttttattttctgtttatttttgttttctgcaccacgcatcctacccccgctcccacccccacccttctgggcgcgcaaaccccctctatttttattttctgtttatttttgtttttctgcaccacgcagcctccctccacccgcgcacaaactccctcaaatagaaatctttttacctttttctgtatttttattttctgtttttttttttattttttgcaccacccactctacccccttatcctccctcccccctcccccctcccccgtgcaaatcccctcaaaattatttttttacctttttttgtattttaatttttttttttcgtttttctgtaccacccactaaacccaactctcccgcgcaaaatatttttcaacttacacattttaaggtaaaagacttttttttttttgcaagatgaacatggttctaaaatatgggtcaagttgggcaggttgggttatgacccattgtttagcccatcttgacccagcccatcttagcccaagtacactttggctgggttgggcaatgactcatttattgatctaacacatcttgacccgtccaaattcaacccaacccgcccatttgccacccctagtttcaataacctagtattttgagacacgaagcgtttatatatatatatatatatatatatattatatgtgtttcataatatcgaaatatgcttttaaatgatgaataatatatgaataaaacgttagaagagtgggttgttaataggcacacatccaattaaacaagatctcattaaatcatgtttatgaattacttttcctaatacaattaaggaatttctgataaattcaatccatcgatattgaaaagtagacatatcccaccaagttgtgcttctctttttctttttttattcttctggtagggtcttgaaaaagaaaaggaaaagaaaaaaaaacgacttaaaaattacaaaagaaaaaagaaagattgttccgcacgtccacaaaactaaataaaggtaaaagattgcaacaaaattaaatcctttattacattgcttatattaattaaattattattataagataatgattaagatggtaatagtcaaaaaatggtgatttggtcatcattatatatgacgttggataaatttagatgggtccatgaggatgacgcatgttttttttttgtactataataaagtaatttaacgaaataatcttcttctactgcgttttttttttttccattaacaaatggttgcaattacaaacatttttataattatataaatcctcactatttatgtctctccatttaatcgcgtctcaacctaatatttaaatctatatagttaacataccaaaaatgatttagccgtagtttcaactaatgatctgttatttctttgtatttgtacaataattctggagaaataaataacataaacagaaatgtaaatgaaataataaaaactaattcgagcccactgaattcacagtgtttccttaagaatttaatcccctcctagtatccaaagttatggattatttcctcccaggatagaacgaattacacccgtgtagtggtacttcaaaccccagtgtttcagcgaacacaaattcggtagcaaatcacacttactgtttctttctttgaagtaaaaatatgcagaaggaagaaggagaactcagaaattagtatgtaaaatcttagagaatatgcttgtatttatagctaaagttgggctgaaatctgaagaggcttgtatttatagccgagccgagccgagcgacgacgacggcgcgaggcttgccttcttctcaactctttaagagcagaagaagagcaattgcttatatacccatcaaaaaccttttcctcttccgatatggaacaatcaaggagggaacctcaaatattactcaaatattttattttccttccatttcccattcaccctattttgaaaaaaataatagtactataaaacagagtctagccatgcaaattaacaagatattattatgtaagcagattttctgaacatcgttcgtgtggaattgtgacaaaagattccaaaaggataatttttaaaatatataaattataaatataaagagaaagcaaaaggaagcaaattggacgagagaagtttgtgcgttggttgttcccttcgtctatttttcaaacatttacaaacgggagacaaattggatttattatgaaaaagtgataaagatatagaataaaatcaatttctttttatctcacactaattaataaagaattaattcctagtcactttatctggcacatggtttgcacatcacttagctttcctaatttttgataaatactcaattagatttgtcttaataaataaatattttttcaaataaaactccaattctggcttaagaaactcttctctaattttatggaaattaagcaatataatgttatggcaaagaattttttatacctcactcaaaagttatctacagataaacctttttaaaaatgatatttatactttcaaaatcagataaattacgtgctaaaacaaataaaagtatatatatatatatatattatatatatataatatacaccactctcgaagacggtattatcaaaggattggttgcagcggatagctgctcctcacttaaccagaggtatcgaattctagtcctagtatgtaaaaattattggtaggaagcgctcccccgaatgggcccaactcgacgcaaatttaaatataatcggactcaaatacagatatcagacatcgaacggaattaaaaaaaaaaagtctccaagatggtataggataatgagacgtgggtcattcatagctccctttatcatagtctaaacaataaacactaaaaataaagggaaaaaacaagattctccttttctttattctttcttaaaataccttttttatcatgatcattataaactaaaatcacaactttgtgcaccgtctaaacatttgtgattagataagaattctttttttatttttgtgtcaagtaatagcaataagtaggctaaagcatttcaagttcgacccttaattaatatacatatctcaagttcgagccttgaaacgaaagaaaatttttgtatataacaatttctttttaatgacgctaagcaagaataaattagttaaatagcttccgagtactgaattattttaccagaaaaaaaaaagccaaagcatggtcattaaattttttttttttttttttaaaaggtcaatagaattttcaagagtgacattatgcacggaaagaataaggcaaaagttatctttaaatcaaactttaatttattccaattggaaaaaaccatgactcttctagaaattatttgtcatttgtaatttatttatagtcgttcttttaaaaaacatttcattcatattaattcatatttcaagaatgaactaattatttttttcatacattgcccttggagtaaatagtatggatatgtgttaggagtgtttatgtgagataataaaagttaatatggtcacttacactgttaattaatgttaaaaggtgaatttcttaatctgtgtgaaaacatccaaaaatcacttattttggactagaggaataccatttaaatatagttaccttttaaatattctaatattccacatcaccttgataattcccagctttatataatatatattgtaaatatttttaatgttaaggcataaaatttaactcatatatatcgtaatattaactcttaaaagataagtattttgattaaattatccttaattaaaattttcatattattaacttgacacatggtcaaatttaaaaaaaaaaaaaaaaaagttaattccaaatgcgaaagaatggtaatttttgtgaattaatacttaaaaaacatatgggaaatatgtagtgtaacgactgtttggttccaccttccggaaccaacgagtgtcaaccaaacgcggtcttctgggcccactataaattgcccttcatttaactcttatttactcaaattgccatttactccttttgttccaaccccgccggccgcccccacaaacttgcgtacgtaatcgcccatggttttcttttttaattttattttcgtctaatattttcaaacctatttttacacttcacaacttttttacagcgaaacaataattacgtttcaattgcaaataaattaatgtcaaatatataaatttttactttttttcttttaagctcaactcattaaatcatcattagaggcagaacaacgttgtagataggagattcactgacctccggtaatttaaaagaaaagtggatatatatgtgtataaaacttaaataacatatatatatatatatatatatatatatatatatatatatatatatataatatatatatatatatatattatatattgaatgacactctaagattcaaaatttcggccgatagattggttgatttggaggcacaacttgacttttaatgcactgcctgggttcgatactgttcctatatatgctcaaattttattcgatagtgatgccctagctactttcaaatcataaggcccccgctacttttaaattctaaatccgccactaattatcataccaaatcaaataaatatttatattatgaaatttatcattaatgcagagttacttcatgacttttcttaagttataagatttcacagaaaatttagcttcttgaatttgctttgtagcatcttgcaatttaaactatttttggtcagacagttgaaacagacacaataattgaggtgttaattagttacaatcaatgaaattatctgatgatgttgtatgatagttttgtctcattagagtaatcagaattcagatgaagtactggtggccaaaaatgaaatggaccaatggatatttttgtaaatctcctcctagatgtaatgtaccacatatttttttctttaaacattcaatttaactcttgttttcattatctatcggggttgcttccgttggtttgaaaggtggttatccgtatggaagaaatttatttagtacgcatagagtgctcaccacaaaatgctgtgcattaatttatccaagtgacatagggaagattcaatgaactatacatcaatcttagatgtacacgaaaacttttctttcacaactatacatatatatatagaaatttatggggtcctggactattcaacctaagatataggtccgccccacaataagtgatcaatttaccttttattttggtccaaaataagtgtctgtttatataatcaagaaaaaatttaatatgttttttcaaatttacccttatgtacgtatctaaaaagtcttttacttgtcacattaactatgttacaacatttaattaagggtagtttagtcactctaacttttatactagtattttatattttttttaatgggtatgcccaaggcaaatgggagaaattcaaaaataaccagatttacaagtggttattcaaaaatagccacactttcaaaagtaatcgaaatttagccacttttcacgtaaagataaatctgaacgaaaacactgttcaaaatccgaaaaatgctccagtgtattatactggagttccagcataagtatactggatttccagcataacacacttgagttccaatataatatactccagcataatatgctggaagttcatacacaggtgctccaatctctagtaaattatgctggaactttccgcattggagttccatcataatatgctggaagttcatacacaggtacaccgatctccagtatattatgctagaactttccgcgttacagcaaaataatggctatttttcaatgacttaacaaacgctgctattttttaatgatgaatccgaaaacttgttagcccgtgttatttggtcacttattatggaccggagaattaaaaaatatctaaaagatcaggaaaaaggaggaattaacactaactttgaggtgtcatcactcctgtgtaattcaacgcggagagaatattcttcttaaaacaaacagaaaacaatgtagtatactgtatgatcaaaatatcaaatagagacagcacgtggtggcagtaaatttgtagttttacatgaatttgtggaaagtggcatttgaagtagttatttctaagaaataagggcattttatttttctattttcaactcatttgactatataaacaaacaaaagagtagcctaacactccattctttgtttcatcaatcagcaaaagacatcaggctctttttttctcccctttgaacaaaaatcacaaaaataaatacatcctctgaattttcaaggtttgtaataccatcttttgatttattttttctttgattttatggagtttttgttggtcttaagtagttccttattttcatggtttaaggttttgtgtttatcttgaaaacatcttaagagaattattctgttatatgttagcagtttatatgcaattcccttctctctttctttccttttttttttgaggtgatggaggtgtaaaagtagtggttttttaaatttgttttgtataaagttttgatttttatgttggggtaagagattatttgcaattcccttctctttttcttccttatttttgtggggagtgatttttgtattttttttgcatatagttttgatttttatgctcaattcattcatggagtgaagaaaggtttaatctttgaagtcttttaggtctattcttttgttttctagtttatcagatttttgttgtttaggtctctgttgttttcattccttctgttggctctgtttcaagtcttttttcatcttctttttaattgcctatttatttttccatttaattgaggtttttttggggtggggtggggtggatgggggggggagggggtgtacagaattaatttgttctaatggtcaagctagctttccatgattacagttttatcatggatttcatgatttatctcttgagttgaagtatccagtgaataaaaagggaaattgattgtacacaaagaaggggggggggaggggggctttctttttctattaccttttctctaaataagctaataaaggctgattgttgattgtaattgagaggtatttgctttttcttgatatgcttctgactctatggtaaacttgctactgcaattaatgttgttattacctatgttgctcggactctccgaaaatgtccatgagtgcgtttcggatcctccaaaaatagtgtattttcgaaagatccgacacgggtgcggcagctgttttagagagtccgcgcaacattggttattactcatttgaaagttaaagaccgagtataactccaagtgcatttgctatttttctatttcttttttctagatgtgagttacttatatttaattttcacttttttcttcccttaattagaagctgcgaacctaacttctctgatgtaggacctcttttagtgttctcttttttctctgcctaatatctctagtttctctgtatggctgtcaaatgaattgaactttcatagttcaagagaaatgaggaaaaagaaagagttccgcttggttggccttcctacgctgacgaatgcctctttctcttctcggaaatctacaacaaacaagtgggagtgggaggattcgaacctacataaaaaaacttaaacagatttacagtctgccgcttttgaccactcggccactctccccttcccgggctgagggccccctcaatgggttctaattctaagaaggcctatgaattagttccaagaaagcggccattcacgtcaggaatagaggccgttaaggatgtacttgcttttcctttttttcatagagattgggttggttaacttttttcttaactaatgtaatttattgctatatatggaaattatgtgttggtgaagagaagagaatgttattagagatgaatcctctgcgattccgggattgttaactttttttcttaactaatgtagtttattgctatatatggaaattatgtcttggtgaagagaaaggaatgttattagagatgaatcctctgtgattcgggattgttaacttttttcttaactaatgtagtttattgctatatatggaaattatgtcttggtgaagagaaaggaatgttattagagatgaatcctctgcgattccgggattgtagaaactaagtatcaagtttagaaacccttgaatgttattatccggagaatgattccgagatggatgataatagtttgtgtcttgcccattttcatgagcgtcttcgtattttgcttttgctcttttttgctttttcataagtagatgtgcattcatttatactttctcggcatatttctttctaattgttctcttatcttaagcattattattaattagtatgtgctttgactgatcatgtttcccattcttggcaggttctgttagttatataggttttgctgacgaatcacgcagtagcaaatctttctctagctctttagatttaacattgtcattcgctgctgaaagaagcgctactccttgagatattgtgactacatgtagttgagagagatttgctaatctggatgtacctccttcactgagatagctttcctctgaaagggttgtttgaaatcactcttcatcttcttaatcattttgatattccagatgcaagcatcccaacgacctcaaatgtctggtggcgtccatggattatacaatcagccaatgcagcaagttgagcaatattacgccccttaccatttcaagaacaacaattgcaataatactagctcagtgacacagtttgcttttcagacacagaatgaacatttcttcactctggactcattgccggctactgactatgttgtatacgattcacctcctgccttaagcgtctcttccaacaggagtcccttctcgccgcaatgttcacagtcatacatgtctgatctgcatcactcctctgataacaacacttgtggttcacctttcagtgggtgttcaggagttgatgatggtgacctgaaacatgtgcttcgggagctggagaataaattactggggcctgaatctgatactgacgacagctgcagttgctccttcaatgatgtggtctcgaaaccttcttccttcacaaggtggaaccgagtgttggacatggctcctagcttgaacttgaaagagttgctcgatgcctgtgctgaagcagtgtctgatgctgatatctcaactgctgaaattcttatgaatattttagagcaaagggtgtcagtctctggggaacctatggaacgattgagtgcatacgtgttggaagggcttagagcacgactctgtcgtcaggaagcatcatatacaaaaaattgaagtgcaaagaaccaactagctcagagttattgtcttatatgcaagtcatctataacatgtgtccatactacaaatttgcttatatgtctgcaaatgtcgtcatcagggaagccatgacgaatgagaacagaatccatatcattgattttcagattgcacagggaagtcagtggatgttcctcctccacgatcttgctcgtcggcctggtggaccccccatttgtccgcatcacaggtgtggatgattcccaatcagctcatgcacgaggtggaggacttcagctagtaggcgaaaggctagcagcagttgccaagtcatgcggagtaccttttgaattccacggtgctgcactatcaggctgtgaggtccaactagagaaccttcgggttagacatggagaagcactggcggtaaacttccctttcatgctgcaccacatgccagacgagagcgtaagcacgatcaaccatcgagaccgcctattaagactagttaagagtttgtcccccaaaattgtgaccttagttgaacaagaatcgaacaccaacaccgcccctttccttccaaggttccgtgaaactcttgattactatacagcaatgttcgagtcaattgatgcagctcgccctaggatgacaagcagcggatcagtgcagaggagcattgtgtggcacgggacattgtcaacataatagcatgtgagggggctgacagagtggaaaggcacgaactttttggaaagtggaggttgagacttatgatggctggatttactccatgcccattgagtccatcagttggcgagaccatcaatgacatgttgaaggagtacagcccaaattacaggtttgcagaaagcgaaggggcactctatcttggatggaaaaatagagctttagcaacttcttctgctggagatgacaacttgttgcctactattgtcaaacatctgtaaatttttgccatatgatctcgacgtttatcttttgttgaagactagaagagtgtttttaacccttttcgtttcatatacagagctcggagtatgaaatcttaggtttgtacatgccagcacagggaggaatatcgcgagtcaaaaatagattccatgtctcaacatctggctattgtcattttctccatgtttgttggcttttctgaactagatcttgagctctatctgctaatgtttgtaacatgaaatccagtttcagcctcttctaagtacaaggtttcttgttttttgtttccctttatgtttgtatgcttttctttagttgtacatttctcttagcagtttaaatggtgtagattgagtgccaccttgggctgaaaaatgtaatattgctctatacgaaaaattaggggtgtgcattcgaatcggtttatcgataagtcgaatcgattatttgttattggtttatcgatttatcgatttcaatttcgaaattttctttatcgagttatcaatttcgatttcgattttgtcatcttcggttatcggtttatcgataaaccgataagatatactaaaaaaacaaatatacccttattttataataccctttcctttactctaagtccctaatcctattatttcctttacccattcttcagtgccgcttttatctttctcctctctcccgcgaactgcaaacccagcagagaaagtgaactccggtgtactctggtgcactctggcgacttcaatagtacgtttctccctcttaccacatttaaggaatggtcatatttaaagctaaagggaatgaagttcaaattaatggaaaacagaattggtggcatacatttgatcccttactttagttttgttgcatgtccttgttgacacaatttttatgttataaacggtgttcgtcttattttagcttctttttgtccatattagttaggcgtgtttatagcgatatactttccgtcgaatcccgcaaatttttattagtgtaatcgataaccgaatcgataagccccaaaaatcgaaaaatcgaaaccttattgaaacgataacgataagcatatacaaatcgataatcaataagtaattatcgataagggtcaaaatcgaatcaataaatcgaatgtacacccctaaaagataatgttaacgaacaagaaaacagatgtgctgttggttcaaatttgagcaaagaaataaaatattaggcgatttctttccgtccgctcccattggggtaaaattactttgtgcctgtgctgttgagatgcgcgcaaacttcttttggacacaaccaaattttagtagtacaaatatttgagaagacatattggaggaggcatccaattgataaagggcagcccggtgcactaagttccgctatgttcggggttcagagaaagcacaaggtctaacaataataagcagccttaccctgcatttctacaagaggtatttaattgattttcacaaataatacttactttctccccgaaaaatagccaaaaaaaaagaaaggaaaagatcatatttgggacaaagaaaaagaaggcaaaactagaaggaaataggggtattatcatttttagctagcgcaagaaattatttatatctggtagccaaaaaagtgtataaaatttgtatatttttgtatataacatataaaatgtatatatatacaattttatacattttttcgactattaattttacatcagctatacaatgtcattttctctaggaaatattagtaatttatgtatagcagattttactgaatacaaaatttagatgaggactgagtaattgattaatagtcagttacaaatgtaaaaagcaagccaaatggatttacatccccaactttcgcataaaaacagattttttttttgttccatttgtttaaaggtggcaaattctaattttttaaatttataaacctttaacaaataaccaaaaatggcgtttaaaagattttgtttgtattttttttctattaatgaaaaaaaaaaacagctcagctttcttttctatctattcttaaagtctgaaattacaaatccctctcttcactcaccattaacacagataggtctttcagtccctatcaaaagaattaatttttatttatttattatgatctttttcaaataaagaatcccccccccacctccccctcccctggatttttcgtgattattcagaaattaaagtctcttttttcaatatttttccatggatgcagatttatgtgttatggatgattaaggacgtgggatattgagttctgttggacataaatttaaggtaattttatttttaatttttttgattttccacccgatgtcatcatccgttattggcatttgcattttatatatgtagggtttattttattcggagcttgttgaatattattagtacataatttgtattttttttttacatttcaatgatattagacatgatatgatctcttttacctgtacatttatctttctcttaatcctctttctccctcgcttccaatttacgtgaacatgtttgactgggcacggagtttaagaaaaaaaagtaagatttttggaattttgggcacggagtttaagaaaaaaagtaagatttttggaatttgtggttctaaaacaagtcacaaaggggctcagagtatttgtgtggttctaaaacaagtcacaaaggggctcagagtatttgtgtggttataaaagtttctcatttctcattaagggtagaattgtgagtttaagctaaattgtttccaaatttagaaaggggtcattctttttggaatggatcaaaaaggaaataagtttacataaactggaacagagagagtaataaataagtttcaagtcaatttttggtattttgtgattcataagttccactaactagacaaaaagagtgattgagttgatacagagacgtacactttattcctgctgtaattactatcttttatctacggtaaagtttgaactcattacgtgcgtctaaccttacacatcatattctagattttatcactttgccatagactaaagagtgattgagtcgatacagaggtgcactttatccctgctgtaattactgtcttttatctacggcaaagtttgaactcatgacgtgcgtctaaccctacacatcatattctagattttatcactttgccatagactaaagagtgattgagtcgatacagaggtgcactttatccctgctgtaattactgttttttatctgcggcaaagtttgaactcatgacgtgcgtctaaccctacacatcatattctagattttatcactttgccgtagactaaagagtgattgagtcgatacagagaggtggactttgtccctgctataattactgtcttttatctccggcaaagattgaactcatgacgtgcgcctaaccctacgcatcagatgctggattttatcactttgccaaagaccatactttattcagattcattttattccaatattaagcatttctgtctctttgtactgattgaagcatgaatttttctgttgcagtgcaatcaggctggagcaaaactgcatgaatacatagttcaatggctactgaagagttatctgaagctaaagaatggcatgttgtaaagaattggcgcaatgtacaaaaagaaaaaaacgagagcgtcgtcgaattcgcgatagattaagaaggcaaacaatgagcctggaggagagggaaaaacatttagctagacgcagaagaaactatcaaatgagaagacaaaaagtgttgaataataattcattttcaagttgtcaaaattatgagagtactactagtacaggaaactcaaatgaagaagaaaatcaagctattgttcctgtttcaggacttggtattcaattatctgagactacattttatcctgaatcttataaatcacaagaagaatcagctgcatcaagttatatattgcaccaaggtatgttatgtatggtataagtatgatttggttagttgttttttttaataacagcggtatctaggttagcttgtatggacctatgttgttcggactcttcgaaaatgtagtcgggtgcgtgtcggattcttcaaatatagtgtatttttggaggaaccaatacaggtgcagcaacattttggagagtccacgcaacataggtgtgcacctcgactatttcatggggtacttgttacctccagagcggacctatgctacatcgagaagggtcaccggcacacgtaaagtttggcaaaacttttatgtgtacgtatatgtctttagaaaatagtgatatattagtagtgagcatcatatatatatataaagctgattttagttgaatccaaaagtgcaactccgaccttcatatccaaaagtgcaactccgaccaatatttacctacgatattggtaccggtaaatctgcctaccaaggcttagacaggtaagaaggaatcacatagtaatatttagaaaacggcttaacatttttttttctattgaaatttcaatctttattttcgatgattttcacctgtttcattgactgctaggctacatatttgtgccatttttgattaggtgttaaggccaataattttactagatattaaggttgtccagggtggtaatactattttattaacttcacagaaaagattcagctttgtttttgtgattgaataggagcagaagaaaggatgaataaagtgcagagaagtccaaatattctgcctttatatcaaataagacatcttgctcgattattgaattctctttcaagcgacaatcaagaaattggtgccaatttaacgacaaatgacaatgttactacagagagtaagttccaacatgtcacaacctctgccctttgggtgagcactttgtgtgcgcggggtaaacttccccggtgtaatagcctgcaaaccacacaggggatgtatcagtataccgcactaggcaagccctatgcgacaggctcaacccagaaaacattgaggggattatatcccggtcatctgtatgaatgaccatcctttaaaccaactgggcaacccgaagggttcagaggttaagtttcaatacatacttttcatgtcttttttcttgtctttctatgttgctcaattttaattgatatttcaggtaaattgcgacgaggtataaggttaattgatgttaagcgtctggcacgagctcttaatgcaaattgaagaatgtttttttctcatttctgtaatatggattttgctagaactgaaaataccaatttaaagttaaaagctcaaacttggttccatattattgttaattataataacattaaggattaatctttacccaaccattatcgagtgctcagtctaaggctttccaaattgctagtgcttaaacaataattttaactttctaaatgtttcagataatggaaacacttaactttgttaatttaattgattcgtgaaccaggagatcaacgctaaagcatatatatatttggtgcaggagttatctgctatacgtactccagcataatattctggattttgacttgtaaaagtccaaactctagctcattgtgttgaagtttcacacacatggagtttctcactctaactcacgccatttgtatgcatccgggtgaatggatcagaatcgtctaaaattttgtggggccatcaaaacgacctaagaaacaatagtcatcgattcgtcgagaccgttccttgttttttgacgttttaaggccttaaaactagaattgtgtccaattttcaaattttcgtgtgtaataacccaagccatatgcatgtgttcatgcgccctgacaggaatcgcctaaaattttgccggcccataataaacagtttaaggaaaaataatcatcgcctcgccacgaccattccttgttttttggcgttctaagaccataaaactggaattccaaattgttcatgtctcgtagcgcgcgccatctacatgggcccgggcgactggatctgagtcgcctaaaacttcccgggccataaaaaacgacctaaggaacaatagtcagcgcctcgccatgatcattactcctttttcagcgttttaggaccataaaactggaattccgcccgatttttagattttcgtatgctatagcccatgccatctgcatggaccccgacgaacaaacccatatcgcctaaaattttactggaccataaaaaacgacctaaggaacaatagtcaccggctacccatgaccattcctcattttttgacgttttaggccataaaactggaatttcgctcgatttccagatttttcatgttctatgacccatgccatctgcatgagcccagacgattgaacccggatagcctaaaattttatcggcccataaaaatgatctaaagaacaatagtcatcgtcttgccatgattgtttctcattttttggcatttaagggccataaaattggaattccgcccgattccatgatttttgctgttatagctcacgccatttgtatgggccgggcaaccgaactcggacaacctaaaatttttccggaccataaaaacgactaaggaataatagtaaacacctctccatgaccgttactcatttttggcgttttagggccataaaactagaattccaaccgattcccaaattttcatgtgctgtaggccacgtcttctgcctgggcctagaccaacggacccggaccgcataaaaatttatcggaccatcaaaactacctgaggaacattcctgtctcaccatgaccgttattcttttttggagttttagggctaagaaatgaaattctgcccgattcccagatttttgtatgttatagctcgcgcctcctacatgggctcaggcactagacccggaccgcctaaaattttgttggaccatcaaaaactacctaatcaccgcctccccattaccgttacacttttgttggcgttttagggtcataaaatttaaattctgctccattcccaaattttcatgtgctaaaagcccacgccttctgcatgaatccaggctaccggacctgcaccgcctaaattttattggaccaaaaattggcctaaggaacatagtcactgcctcgccatgattattactcgtttttggtgttttaggaccattaaaccggaatttcgccccattcccagattttcgtgtgctataacccacgccttctacgtggcctgggccaccagacctgatcctcctaaaactttgctagaccataaaaaatgacctaaggaacaatagtcactgcctcgccataaccgttactaagttttggtattttagggccatataaatggaattccacccgattctcatattttcatatgctaattgctcacaccttctgcatggtctggtccaccggacgcggacaacctaaaattttgttggaccattaaaaacaacataagaaacaatattcaccacctcgcatgactgtcactcatttttttgcttattagggccataaaactggaattcgcccgattccatattttcatgtgctacagtccacgccttctacatggcccgggccacctggatcgcctaaaatttatgggaccatcaaaaactacctaaggaacaatagtcactgcctcgccataaatgttactcagtttttggtgttgtagggccacaaatatggaatttcgtctgattcctagatttttgtgtgctataggcctctaacttcaccatgggcccgagccaccagaccttgagcgcataaaaattttccgtactataaaaattgtccgaaggaacaatactccccacttctccatgaccgttattcgtttgttggtatttgagggctataaaaataaaatttcgcacgattcccagattttcatatgctataactcgcgccttctacatgggcctgccggacgagaactgcctaaaattttgccggatcatcaaatgcgacctaaggaataatagtcactgctttgccatgaccgttacacgtttttggtattttagggccataaaactgaaattttgtcagattctcaaatttttgtgtcctatagcccacgccttctacatgggctcgggtcaccagatctggaccgcctaaaattttaccggaccatcaaaaatgacctaaggaacaatagccaccacctcgcatgaccgtcactcgtttttttgcttctagggccataaaactgaaattccgcctgattcccatattttcgtgtactatagacttcagcatgggccagggccattggaccgcctgaaatttttccggaccatcaaatacaacctaaggaacaatagttaccgccttgtcatgaccgttactcttttttggcgtactaggaccataaagcttgaattccgcccgattctcaaattttcatgtgctatagcacacgcctctgcatgagcccaagccaccagaactggatcgcttaaaattttgctgaaccataaaaaatgacctaaggaacaataattaccacatctccatgatcgttactcattttttagtattttgggccataaaaataaaattccgcatgattttcatatctttgtgtgctattgcccatgcattctgtgtgggaccgagccaccagacccggatcaaataaaatcttgtcgggccttcaaaatctatctaaggaacaatagtcaccgcatcgccatgaccattactcatcttttggtgatttagggccattaaactggaattttgcctcattcctagattttcgattgctatagtgcagaccactagatctagactgcttaaaattttgtcgggccatcaaaaatgacttaaggaacaatatttactgtctctccatgaccgtttttcatgtttggtattttagggccataaaaatggaattcctcctaattcccagattttcgtgtgctatatagccgactccttctgcatagaccgggatcaccagaccaggaccacctaaatttttctgaaccatcaaaaactatctaaggaacaatagtcacctcctcgccatgacctttattcgtttttgtgttttagggccgaaaaatagaattccgccgaatcccacattttcgtgtgttgtagctcacgccttctgtatggacctagggcactagatcccgaccgccaaaagtttgtcggaccatcaaaatttacctaaagaaaaatactctccacctccccttgtctgttacacgtgttttggcattttaaggccaaaaaataaattacgtgtgattcccagatttttgtgtgctatagcccgcgccttctgcatgggcccatgtcacaagaccctgaccgcctaaaattttgtcggaccatcaaactagacctaaggaacaatagtcaccacctcaccatgatgattacatgtttttggcattttatggccataaaattggaattccgcccgattctcagatttttgtgtgctatagttcacgccttctacatgggccccggcaaccgaacccacaccacctaaaatttttggaccgtcaaaaacaacctaaggaaaatagttattgtctcgccatgactgttactcgtttttctgcattttaaggccattaaactgggactccgcccaattcctagattttcgattgctatagccacaacttcttcatgggcccggcccaccggacctggactgcctaatatatttttggacagtcaaaaactacctaaggaataatagtcaccgcctcgctatggccgttactcgtttttttggcgttttagggccacaaaataaaattccgccaattcccatatgttcaggagttatagccacgccttctgtataggctttggcccaggacccggaccgcctaaaattttgtcggaccatcaaaagcaacctaaggaacaataatcacgccttgccatggtcgttactcatttttagcattttagggcataaagttggaaattggctcgattcccaaattttcatatgctaaagcccacatctttgcatgtgtagaagtatagtatgaatataccacggtgttaccacagcaagtatcaagactgacctcagtagtgacgagaaacagtcaagacacctacttgactaaataacctgaacaagtataagtaatggaacaacagagtatgatatataataaagactatgcgaaaggcaaataatacgtaattgcagtaaggaaggaaaacaacaactattagtggaacaccataataatgacctagaaaaatgaacagaaacacaacataaatccaataatcacagataaggaaaggacaagtaataactcaacaacaacgaccgttttcacatcaggttttagtcaataaactccacgaggtatcgatcctcgggctaatcacaaactcacgggttctcaatacatgaaccctaacccttggcatcatgtgccctcattacacctcatacccgcactgactactcacgtgccaaataaatccattctcgcatagaagccatcaaaaatcattacaattaatccctgacacagctcatattgcctcgccacgtgtgcaataataaagtaagtgcccgccttatctcgctgcatatgcaaatatcagtagtaacaataacacggcaaaaaacctcgtgcaacccataacaacaaccgcacggcagaaacctcgtgcatcacaataataacaaccgcacggcagaaacttcaagcatcaccacaacaagtacaacagcagcaatgacaataaaacaaagtacgacaagtaagtcaactcaagaaccttcgatcacagaaaaggtagaactagttcacaaggaataccataataaagaatactaggcataataagaacagctcaacagggaaagaaataatatgtaacaatggtcccacaatgtacggttcaaccacaagaaactaacgcgagtcaaataattccaaataagggcaagtcaataaggcaataggatatctaagcttcttttatgtttagacaattacgaaagagatacaactaattcaattaaaggtaggaagcgggaagataaccaaacctcaattaaggatgaaacaaatacaaaagggatagctataacttcaaataaagataagcagttagggaaaagataacatggcaatagaagagataacagtttcaattaaggcacatatgaatcaagtaaagaatagagtggaccatgaagcaattgattctaattaagcaggtaaaggtcaaactaataattaaggaacataatcgtaataagaacaactgtatattcaatgaatataggacctaggaaccctaaagggacaatttccacaaataatccgagcacgcacttgtcacctcacgtacacggactacaattagcatagaagacttaaatcctaaggggtagttcccccacacaaggttaggcaagatacttacctcaaagaagacaaactgatactctaaaatgagcttctcgggtaaatgacctctagacggctcaaatctaaccaaaaataataaagtctaaatctttatcaaaatctaaaaatcgactcaaaagtagactcccggtcccgcacctcggaacccgacaaattttcacaaaacctaaacacccattccaatacaagttcaaccatgttaaaattatcaaattgcaataccaattcgtccctcaaatcatgatttttcattttgaaatttttttacaaaaacctccatttttctcagctcaaaacacaaactaaatgataaaaataaagataaaacatggaatataataaattctaggtgaagaacacttacccaatcgatttgcttgaaaaacccacaaaaaagctcccaaaatcaagctctaaaactcaaaatatgaagaaaatggccaaaccctcggcttagatgttctgcttagacttatgcatttgcgaacaaggagcgcacctgcgcgcatgcatttgcgagtaaaagttcgcatctgtgaacacagcttaccaggaccaggttcgcttctgcagacaacatagccgcaccagcggtaccgtagaagcgatgacaggagcacataagcggactccttcacagatgcgatcactcaactgcaaaaacggccttcacatctacgtgccaccatccgcaaaagcgggctagctcccataccccaacgatcgcagaagtgaccaagctcacgcagaagtcgagccgcacctgcgctctaagatgtcgcagatgcgagacaccaaacccaaacctagccaaaactatgaaaaccatctgaagctcacccgaaacacaaccagggccccccggacctcgtccaagcataccaacaagttccatgccctaacacggacccgctcgaggtctcaaatcacatcaaacaacatcaaaaccacgaatcacaccacaaatcgagcttatgaacttttaaatcttccaactcctaaaacttgccaaatgccaaattatttgattttccgaaaactagacacaaagggctacaactttcatttttgaatcatcttcaaattctttatagattgaaagatacaagcttccaaatttggatcagtgcagcagaatatttcctctacgtgatcacaagagctcctccgtgatcatcccaaatccccacgatcgtgtagcacactgttgtagccaaaatcatcaactaaaaatggcttagaaatggtccgaaaccacctgaaactcacccaagcccctcgagaccccgtccgaacatacctaaaagtctcaaaatatatcacagacttagtcgaggactcaaatcacatcaaacaatgctaaaacacaaatcataccccaattcgagtatgaaactaagaaattttaatttctacattcgatgcagaaacctatcaaatcatggtccgattgaagtgggctacacaaaaagttaagattttcaaacgcgtatatgcgaaaactgtcattgctatttggatggaaatgaactagaggatattcaaaaaggaatgtttcgccatgactgatcctcatttcttggcgttttagggccataaaactcgaattgctcccgactcccaaaatttcgtgtgctatagcacatgccttctgtatgagcctgaacaattggaactgtcaaaaattatgatggaccataaaaaatgagctagggaatgataatcaccgtctcaccacgaccattataattttttagcattttagggccataaaactggaagtccgctcgattccaagatttttataagttatagcccatatcttctacatgggcccgggttaccagacgcggaccgcctaaaaattttctgaaccatcaaaaatgacctaggtaacattagtcatcacctcaccatgaatgttatttttggcgttttagggtcataataatggaattcgcgcgattcccagattttcatgtctatagcccacgtcttctacatggtccctggccaccaaacttgaatcgcctacaattttttcggaccatcaaaaattacctacaaaacaattatcactgcctcgcaattacagttactggttttttagagttttagggccataaaaataaaatttctcccgattccgatgttttcgtgtactatagcccacaccttctgtatgggcccgaaacgccgaaccaggatcacctaatattttgacggaccatagaaaataacctatggagcaatagtcattgcctccccatgaccactacttgttttttgtcgtattagggccataaaaatgaaattccactagatacccagattttcatgtgttatagcccacgccttctgcattggctagggccaccaaacccggacctccaaaaatttttgctagccatcaatactgacctaaggaacaatagtcattgcctcgctatgacagttcctcatttttggagttttaggaccataaagctagaatttttcccgattctcagatcttcgtgtggtgtagcccacgccttctaaatgggctcgggccacgagagccagaacgccaaaaattttgccggaccataaaaaatgacctaaggaacaatagtcaccatctcgtcatgaacattactcattttttagcattttagggccataaaactggaattccattcgatacacagattctcgtgtgctatagtccaggcatttgcatgagcccgggccaccgaacccaaattgtctaaacttttgtcggaccttcaaaaatgacctaagaaacaataatcattgcctctccatgaccgttactcgatttttgggcctttagggatataaaaagaatccgctcgactgccagatttttgtgtgctatagtacacgtcttctacatgggcccgaaccaccagaagcctaaaatttttccagaccatcaaaaatgacctacgaaaaatagtcacctccgcgccatgatcgttcttcctttttttggcgttttagggccatgaaaaggaaattaggccctattcccaaattttcgtatgctatagcctacaccttctacatgcacccgggctacctgatccagactgcctaaaactttttcggaccatcaaacatgacctaaggaaaaatagtcccttattcgccatgaccattactcattttttggcgtttcagggccatagaactggaattccgcccaattctctgattttcatgtgctttagcccacgccttttgcatgggcccgggccaccggacccggaccacctaaattttgctttaccataaaaaatgacacaaggattgatagccatctcctcttcatgaccgttccttatgtttttggcgtttttaggccataaaactagaattccaccgattcccagatttttgtgtgctctagtccatgcatcatgcatgggcccgagctaccggacgcgagttgcctaaaattttgtcggaccacaagaaacaatataaggaacaacagttaccacctcgccatgaccgttactcattttttggcattttagggccataaaaaatggaattctgcctattcccaaattttttatgttacagcccacgccttctgtatgggccgggggtaccggacgcagatcgcctaaaattttgccggaccatcaaaaataacctaaagaacaatagtcaccgcctcgccacgactgttactcgtctttttagcattttagagacataaaaatggaattcaacgcaattttcagattttcgtgtgctatagccattcctgctgatgggctcgagctattggaccctgactgcctgaaattttgtcggaccttcaaaaacaacctaaggatcaatagtcatcaccccgcagaccgttactcgtttttagcattttagggacataaaaatagaattccagccgatacctagattttcgtgtgttatagcttacgccttctgcatgggcccgggccaccaaaccccgaccgcctaaaatcttaccggaccaacaaagatgacctaaggaacagtagtcacctccacgccatgaccgttactcttttttggcgttttagggccatacaaattaaattccactagattcccatatttttgtatgatatagcccacgccttctgcattagcccgggccactagactcggaccgccaaaaattttaccggacgatcaaaaatgacctaaggaataatagtcaccgcctcgccacgacggttcctcattttagcattttaggtccataaaaatagaattctatcggattcccaaatttttgtagactatagcccacaccttctgcatggggcggggccaccgtacccggaccgactaaaattttgtcaaaccatcaaaaatgacctaaggagaaatagtcaccacctcgccatatcagttactcattttttggcgttttagggccacaaaaattgaattccgcccaattcttagaatctcatgtgctttatcccacaccttgtgcgtgggcccgggccaccgtgccggaccgcctgaaatatttccagaccatcaaaaataacctaaggaacaaagtttatcgcctcgccataatcattattcattttttggtgttttaggccataaaaatggaatttcacccaattcccacattttaatatgttatgttgcccacgcgttccgcatgggcacgggccaccggataccgactgcccaaaatttccggaccatcaaaaatgacctaaggaataataatgaccacctcaccatgtctgctacttattttttggcgttttagggcataagaacataactctgcctggttctcagatttttgtgtgcaatagcccacgccttatgcatggggtgatcatttctctttttgctggatcataaaaatgacctaagaaaaaatagtcaccgcctaaccttgattgttcctcgtttttggcgatttagggtcataaaagtggaattccgccctggttataattttcgtgtgctatagcctgcgccttctgcgtgggcttgggacaccagttctcgaccgcctaaaattctacttgacattaaaaaatgacctaagaaacaataatcatcgcgctgccatgatcgttacacattttttggattttagggacgtaaaaatggaattccgcccgatacctagattttcatgtgctatagctcgcgccttctgtatgggcccgaaccatcggacccccaccttctaaaatttttccgaactatcaaaaattacctaataaataatagtcactgcctctccatcaccgttactcattttatttggcgttttagggccataaaactagaatttcgcctgattcccagattttcgtatgttatagcccactccttctgcatgggcccgggccaccggacccaaaccgcctaaaaagtttccgggccttcaaaaacgaccttaggaacaatactcatcgtttctccttgatcgttccttgttttatggcattttaaggccataaaatttaaatgccacccatttgctaaagtttcatgtgttatagcccacgtcaactgcttgtatccaggcaaccagacttgaattacctaaaattttgcaggttcatcaaaaataacctaaggaacaatcgtcatcacttagccatattcgttcctcttttttcgtgttttagggccataaagctagagttccgcctgattcctaaatattcgtgtgctatagcctacgccatctgcttgcatctgagcgactggaccggaatcgcttaaaattttgtcaggccatctataataacctaagggacaatagtcatctcttcgccataacagttcctcgttttcttggcgtttttgagccataaaactaaaattccaccggattctcagatttttgtgttatagcccacgccatttgcatgcatcccggcgactggaccctaaatgcctaaaattttaccgtgccattaaaaatgacctaaggaacattagtcatcgctttgccatgaccattcctcatttttttggcgtcttagggccataaaactggaattataaccgatttcaagatttttatgtgctatatcccacgctatctccatgcatccgggcgaccagacccgaatcgcctaaaatttttctgagccatcaaaaacgaccattcctcattttaagctttttaggcctatacaacatgaattaagtacggttttttaattctttttgtgtgttaatgtccactctatcttgatgaattcgagcgaccggctctgaatcacctacaatattgtgtgcccattaaaaatgatccaatgatagtcatcacttcgctacgattgttcctcaattttttggcgttttagggccgcgaaaaaggaatccatgatgatttcttatttttcatgtgctaatgtccacgtcatcttaattaattcggacgacaggctccgaatcgccaaaagtttttgtggccccattagaaatgatctaaagaacaatagtcattgcttccatgagcgttccttgtttttaggtattttagggccataaaacaggaatttagaatgttttcaatttttcgtacgttaatatccacgccatcttcttgaattcgggcgacgggctccaaggaatcatataattttgtagacccaacaaaaatgatttaataaacattagtcattttttcaccatgaccaatcctcatttttggcattttagggtcataaactggaattcaatacaatttctaattttttcgtgtgctaatgtccatgctattttcatgaattcaggcaacgagctccgaattgcctaaaacattataggcccattagagagaataaatgaacaatagttattgtttcaccatgatcgttcctggttggcattttaggccataaaatagggattcaggaagatttttagttttttgtgggttaatattcacgtcatcttcatgaattcgggtgacgggctccgaattgcctacaattttatggagccgttaaaaccgacctaatgaacaataatcactgctttgcaatgaccattcctctattttggtgttttagggcgataaaataggatttcatgctgatttctaattttttggatgctaatgcccacgctatcttcatgaaatcgtgtgacggactctgaatcacctaaaattttgtggacccatcatgaaaaacctaatgaacaatagtcatttttttccaagaccgttcctcattttttggcattttataaaacaagaattaaggataatttctattttttcgtgtcctaatatccatgacatcttcatgaattcggtcgatggacttcgaatcagctaaaatttattgggcatataaaaaatgacctaataaaaaataggcattgcttttccatgagtgttcctcattttttgccatttcagtgcgataaatcaggaattcaaggcgaatttcaattcttcaaatgctaattttatgccatcttcataaattcggcagaagggttccgattcgtcttaaattttgtgggcccatcagaaatgacctaatgaaaaataatcatcatttcgccatgatcatttcctattatttggtcttttagggccataaaactagaattggggatgatttctaatttttcgtgtgataatgcctgtgccatcttcatgaatttgggcaacatgctttgaattgcctaaattttttgggctcatcagaaacgacctaattaacaataatcattgcttcaacatgatcgttcctcttttatggcgttatacgaccaaaaaataggaaactttgtgacctgataaacaataatcattaatttgccatgactgtttttttttttgggcattttagggccataaataggaatttaagatgacttccaaattttcgtgtgctaatgtccacgccattttcatgaattcaggcgacagactccgaatcgcctaaaatgttatgggccaatcagaaatgacttaatgaacaatggttatcgcgtcgccatccgtgttccttatttttaagcattttagaaccgtaaaacaagaatttaggacgatttccaatttaacgtgggctaatgttcatgccatctaaatgaatttgggcgacaggctccgaatcacctaaaattttgtgagccaataaaaaatgaccaactgaacaataattattgcttctctatgactgttcctccattttttttgcattttagggcaaaaaataggaatttagggcgattttcaatttttcgtgtgctagtgcccaagtcatctttgtgaatgtgggagacaggctaagaatcgtctaaaattatgtgggcccatcaaaaatggcctaatgaaaatttgttatggagaaattcctcattttccgatattttagggccataaaataggaatttacaatgatttccaatttttcgtgtgttaacgtccaagccatcttcatgaattcgggagaagggttccaaatcgccaaaaatttagtggtctatcaaaaattacctaacgaacatattttcagaatgattttcagtttttcatgtgctaatgtccacgtcatcttcatgaattcgagtaatggattccgatttgcctaaaatttgttaaggcccataataataacctaataagtaatggtattcgtgtcgccatgagttttcctcgctcttggacttttagagccataaaacaggaattcatgatgtttcttattttttgtaattcccatgccatcttcatgaattcgagcgacgggatttgaatcacttaaaattttgtgggcccataagaaacgacctaaagaacaatagttattgcttctccatgattgtccctcgctttttggtattttagggccattaaacagtaattcaaggtgattttagatttttgtgtgctaatgtccacgccatcttcatcaattcggggaactagctctgaatcgcctaaaattttatgggcccatcagaaacgacatagtgacaataggcattgcttcaacgtgattgttccttattttttgcgtattagggtcataaaacaggaattcacgaagatttctaattttttgtatgcattccatgccatcttcataaattcgggcgacgagctccgaatcgcctaagattttgtagccccattacaaacgactaatgaacaatagtcattgttttgccaggatcattcctcgtctttctacgttttagggccataaaacgggattataggacaatttctaacttttcgtgtgctaatgtccacgccatctccatgaatttgggcgacagactccgatcgcctaaaatttttatgcgacatcacaaacgagcaaatgaacaatagtcattatttagcaattgctccttttttgacatatctgggccataaaataggaatttaggatgattcccgatttttcgtgtgcaaataccatcttcatgaattcgggagacggacactaattgtattaaattttgttgatccatcacaaacgacctaataaaatccttattttttgcattttagggccataaaagaggaattcgggacaatttttaattttttgtgtgctactgtctatgccatctcaagagtttgagcacatgctttgaatcacctaaaattgtgtgtgcccatcagatatgacctacagaataatagcctttacttcgccatgaccgttctccattttttttacattttagggtaataaaacaagaatttaaggagatttttaatttttcgtgtgctaatatccatgctattcatgaattcgggcgacgggtttcgaattacctaaaattttgtgggcccataatagatgacctaacgaacaatagtcattacttctacattattgtttctcatttttttttggcattgtagggatataaaacaggaattcagggtgatttctaatttttcttatgccaatgtctatgtcatcatcgtgaatttgggcgacgggctccgaatcgcctgaaattttttgggcccatcaaaaatgacctattgaacaattgtcattgcttagccatgaccgttctttatttatttttttgaagttttagagccacaaaacaggaattcatgattatttctaatttttcatgtgctaatgtccacgcttctcggccgatgggctctgaatcaccttaaactttttgggcccatcagaaatgacctactaaacaatagtcattgcttagccttaaatatttttcttttttgggggcatttttagggccataaaataggaatgtaaagagatttctaattttttgtgcgctaatgtccacgccatcttcatgaattcggacggcggattccaaatcacctaaaattttatgaggccaccagaaatgacttaatgattaatattcatttcttatccatgagtgttcctcgtctttgacattttacgaccataaaataagaatttaggatgattttcgatttttcgtttgctaatgtccatgtcatcttcatgaatttgggcgacgggctccgaatcacctaaaattttgtggaccctttagaaacaatcgaatgaataatagtcattgcgtaccatgtctgttccttatattttaatattttaggatcataaaataagaatttagaaccattttcgatttttcgtatgctaatgtcaatgccatcttcatgaattcgggcgatgggttctgaagtgcctaaaattttgtgggtccaccagatatgacctatagaataatgtctttgcttcaccatgagtgttcctcgtttttttgatttagggctataaaacaagaatttagagcaatttcaagttttacgtgtgctaatgtccacgccatcttcattaattcaagcgaggggtttcggatcgcctaaaattttatgggcccattagaaattaccttatgaacaatagccattatttctccatgatcgttcctcattatttgcattgtagggaataaaacaggaattcagggcgatttctaatttttcgtgtgcgaatgttagtgtcatcttcatgaatttgggcaacatgctccaaatcgcctaaaactttatgtgcccatcagaaatgacctaatgaacaatgatcattgcttagccttgaattttcctcctatttggtgttttgggccactaaataagaatttatgatgatttttatttttcgcgtgctattatccacgccatcttaatgaattcgagcgacgggctccgaatcatctaaaattttgtggatgcatcagaaacgacctagagaacaataatcattacttcgatatgcatgttacttattttttggtattttagggccataaaacgggaatttaaggcgatttccaattcatgtgttaatgtccacgccatcttcatgaattcggacgacggctccgaatcatctaaaattttatgggcccattaaaaatgacgtaatgaacaatagtcattacttctccttgaccattccttatttttttggcgttttaaggccataaaataggaatttagaatattttgattttcgtgtgctaatgtccacgctatcttcatgaatacgggctatgggcactgaatcaccttaaacttttggacccattgaaaataaccaatgaacaatcgttattgcttcaccatgaccgtccctcattttttgatgttttagggccatagaaaatgaagtcaggataattccaattttttcgtatgttaatgtacacgcttctttatgaattcaggcgacaggctctaaatcttctaaaaattttgtggagctatcaaaaatgagcgaatgaataataatcatttctttcatggcctttcttgtttttggtattttagggccataaaacaggaattcaggacgattttcaatatttccgtatgctaacgcccatgccatcttctgaatttgggtgacgggcgacgaatcatctaaaattttatgggcctattaaaaatgacctaatgaatattagtcattacttcgtcttgaccattcttcattttttggtgttttaaggccataaattgggaatttaggataatttcgattttcatgtgctaatatccacgccatcttcatgaattttggtgatgggctccgaatcgcctaaaaaaattgatccattagaaacaacctaatgaacaatagtcattgcttcgtcatgatcgtccctcgttttttgcattttagggccataaaaaagaaattgaggacaatttccaatttttcgcatgttaatgtccatgccatctttgtgaattccggcgacgggctccaaattgcctaaatttttgtggagctatcaaaaacgagctaatggataatcatttctttgccatgcccttccttgttttttggcattttagagccataaacaggaattcatggcaatttttaattttttcgtgtgctaatgcatatgccatcttcatgaattcaggtgacggactctgaatgcctaatattttgtgggcccatcaaaacaacctaatgaacattgcttcgccatgatccttcctcttttttggcattttagggccataaaataggaattcaggccgattttcaatttttcgtgtgctaacgtccacgctctctccttgaattcgagcgacaccttccgaatcgtctaaaatttcttgggcctatcaaaaacgagtaatgaacaatagtcattgcttcgtcataccattactcgttatttggcgttttaggaccataaaatagaaatttagaataattttttatttttcgtgtgctaatgtccacgtcatatttatgaattcggcaacatgcttcgaatcacctaaattttgtggcccgtcaaaaacgacctaatgaataatagttattgctttgccataaccaatcctaattttttagcattttaatcacaatattttgaattaagacgtaattgttatttgttaaaactgtataaaacaaaactagtcatataactagaaagagacatttattaattgtgaagaaaatgatttgcatgcatatgaaaggcttatttgagaatagggagattttcttaaatatactaatggtaactttaataattaataactaaggtttcattaaaactcaatttccaacaagttattaaataagtttcactataaaaggttttatttacctcgacttatttacaaattcagtaattgaaattatcaaagtttttattccacttatattccttctgactttaggctattttaattgtacaaggttttcaattcttcttatttggaaatttacaaaatatgtaacaccctttactttctcctactcaacgtaggaaaaggatgaaacaatttcactttgatttatactataaataatcggaaaaaattccaatctcaattcctactcaggtaagaaaatacacttaattcctatataaacaaataattccatagcaattgaacatagtctttcttcttgtttttttttcttttctcatggaaggttcaaataataaaactccaatggattatcaagattttcttcgttcttttcaagatttgaacttgagaaaaaatagtgcaaattcttctttgaacaatcaagcagagaatggttttaatattccaaaagaaagtgacagaatttgggcaatttcgtctgataatgaaactaatgatagttctttttcttggttgagttctacaagtaataataaagaagactacttttctaaagattcaaaattttcaatgagtcaaaatagtattcaatcatcattagaatggccgtcaacaagttcttcaaatatttgggcttatgagaatcataattccaacaatggaagtaagtataaagttcacaactttactttattcatgcatgcagactagttgtttttcttttaatttttattttaatttgtattttcctgtcaatatattcaagatttattgtactgagacgagggtctgccgaaaataacctctctgccctagtggggtaggggtaaggttgcgtacacactattctcctcctaccccacttgtgagattttactggttgttgttgtagttgttgtatattcaagattttttgtcctgagtgtctatcggaaacagcctctctgccctagcggggtaggagtaaggtctgcgtacgcactaccctccccataccccacttgtgggattttactggtcgttattgttattgttgatgttgtatattcaagatttcttgtcccgagggtctatcggaaacagcctctctgccccactgggtagaggtaaggtctgcgtacacactaccttcccagaccccacttgtgggatttagtggcgtcgtcgttgttgttgtatattctaagatttcttggttttcttgtgtttgtttctgcagtttcaagcaccaactcttcacagaaaagctcattggattatgcagatatttataggaattatgtgccacaaacaacaagtaccaattatgaatatggttcttcttcatcatataattccatgaatcaatccaactatgatcaaattttaagcaacaacatgttaacaatagcaacattggagctcaagaatttgcagataacaatgagcttcctttagactataaagattggagtaatgaggattatacaaagtgtttaaatgtcctgttgaatcagagtattgcagcattatgttatggttatcttccaaatctaggattcgacgtcattaagatggctaaaagtcccagagcctcgcgcttattgcaaaattttctgcagctgaataactattactacaggcaaaggatacttaatgagattcttcattctttttatgaggtgatgatcgatgaatttggacacgctttcttcctaaaacttgttgaattctgcaacgacgaacagatggaactaattctcagtacatttcacttcaatgtggagttgtttgtacaaacagcctttaagaaatatgggtgagtagagatatattaagtacttaacagttttgcattctgaatactggcctatctaacatttttccttttgctttgacagttcaaagtccattcaaatgctgattaaaaacctcaaaaagaaacctttggccaactatttctcagaaattgtgtctgttaggttagttgaactgatgactcatcgaacagggcgatacgttgttgaacaatgtttccatgtcttcaatgagaagcagaatgaggtaaaaattgttactacagttttgtggttgcttgtcatataatagtaaaaaaattgtagcctaacagatatgaatattgcacactgatttcaggttctgtactgggggattattagatttttcaaagagttggctacaaatgaaagtggatgtgcatctttgaatattggcatcaattgtatcactaaccctttgagaaaggatctacttgaaaaaatagcaaaccagtcaggttaccttgccaatgatccctgggggtaagtaataacatatagtttcctcctctgttaaatttgggatcattcatatgcttgtcataagcaaatcatctcgtatttgtccttgactctaacggagatccagcatagactaggtaaattcccaagtgtcgaaatacttaggaaaaagtgcaattttgctcctctaaaatcgctagcagtgctagacaaaacactatcatactcgtcggtacaaagagggaaaccgctcgactatcctttaacctacaacccctaatgctcgacctccacaccttcctatcaagagccatgtcctcggaaatctggagtcgagccacgccatatcctgtgtgatcacctcgccccaatacttcttaggccgccctctacctcttctcgtactatggtttaaaatatttcaaataagagttgccttaggatcaagggaaaatacgagacgatttgctaatggcaagggtatgcaaggacataatacgtgtaaaattaagatatttccacttttcccattcttttactactgttgactaaaccagaatttgtgtgtttttgttacaacaggaactatgttgtgcagcatgttcttgaactaagggatgaagagatttcaagtaagatattcagtcaacttaagaagcagtattcaacactagcctacaaaaagggtggtagccatgttgttgagaaatgcatagagtcatcaaatgttggaatgatttcagtagttgatgttcttctagctgatgaaaaatcactaattcaccttgccaaagatccctttggaaattatgtaattcagaaagcattaaaatcaacaaaagtaagtaatccttattgtcctttttagctccatagccacacaacataaaccattttctccattatcagcagaggcggacccagaatttttacgcgacgcccaaccagtgccccctaaatgcttttagcgtacagggtgccagctactttaaattaacaattttcaagatatatacatatatatacaggatttcggctgaagtttacgaggtccagtgacccctaacccatacacatgggtccgcctctgcttatctgtaatagcacatcaaaactaataactgatttaagattcattacattgtatctattttctgattgcaggaacaaggagaggaaaggcggcatcaagctctcgttagagtcctcatgcggcattcctcagctcttttacacagcaaaactgggaaacatgtgatcttaagtatcaaaagtctaaatccagattattagacagccttgaattcattgtcaagccaatgttaaagaggacaatcttgtttctatgtttcttgtttatgtttatgttacttctgtgtaatctgtgtcttttctttgtacacaaggggtgaattggagatgatgcaaatcagtgactaaaattgtagttaagtgttagcaactaggatttgtttgagagttatagtctggcattttggtagaaatattttgtaagagcttttgtgttgtaccacaaaagcatttattatctatattcttgacccttaatctgaaacctacatcttttatgttttttgcagtttgggaattacttaaattttgtgtttgagacaagaagtttatgccttttggttcaaaatgttgtattatcaattaaatgtaaatataacgattttttttctttgatattggaaacagcaaagggccaaatatacccctatactatgagaaaaggtttaaatatacccttcgttatactttgagtccaaatatacctccgccgtaatactatcgattcaaatataccatttttctgttatgtttgtccaaagtggacattcaatcctacgtggcactaacatttgatgaggtggatgccacatgacatgccacttcaacgcccctaatccatatataaaagaccaaaatttgaaatataatactttttatggtagcggtaatggtggtaataatggtagtgggaaaaaaatttagtggtggaaaaaaaatagaaagggggggtaaaatgggttagggacgctgaggtggcaatccatgtggcatccacctcatcaaatgttagtgcctcgtaggattgaatgtccactttggacaaacttaatgaaaaacagatatatatgaaccaatagtataacaatgatggtatatttgaactcaaaatataacgaggggtaaatttacctttttgttattacaggggtatatttggcccttttccgtattggaaaacaaagttttatagaatgattattctctttatacttaactccttctccttgaaaaggccctttatagtaaaatttggaaccaaaagttagtccattctttcaatcatgaatacatacatacacacaagggagaagcatgaagacaaaggaaattaaatgtgcaataagatctgctttttctaattcacaccagaaaatgaacactgctcatcatagacagccatttcatgtttatcgatttgggaggggacaatagtacttgtgtccgagccaacttgctcgcaccttaataatgtcataggatactagctacctcccactagcacagataccggataactctgtccacagcggcttgggcagatcagagacttggaagtacaatagtctgttaacatttctaagcaaatggcctataaacatctacagagatattggaagtgcaaagctccgtagcagaaaagtggcatcagtatcctattatattgcacagacaaagtgctggtgatatattactatcccagttaataatacaagacaattaaagaacagagctgcattgaaccttctgagactccagaacacttctagtagcctctttgaccacttgtccactcacgtagtgctttcggcacacaggcatatacacatctgctcctgcaatcaactccgttctgtctcctctgtctttctcaaggtaaaagaagcacgtttgccacaaagttcacatcgggaagttagtttggtcacagtatcagcaattggaattatgtcgagaactgaaccaaagcttcttctgcaaaatgcggaatatgaatccgataaagaatcagtacacgggtacaaaaatacccgaggataatagcacgacaggtaacttagcatcacatttagtacatatgaattattcaaagggataagcacaatacgtctttccacagaaaatggaagtagtacctcagatagtcaccatccaacccagcaactatcacaatcttgccatcatggtcggcagcttctgtgcagaaatcatatagatcctcaaaaaactgagcttcgtcaatgccaatgacctctaactgaagccatgtaacagtcacaaaaaagtatagtcacatatactagcaaagaaaattgagcgatgatatagcataaaccatgtaaaagacacaatacagtattgtaacatactagcaaaaaagttcaatgacaactttcaaagctagtgcttcatgattatatcattcaaaaatagacttcttgagccaaacttttagagaaaaatttatgtttctagcgcccctaattacacattgagaaggtcctatgctaatcatctaatatattcacaatattttaccgttgtagtgttaccttactgtatgcttcagaaccacatctctgtttgaatgacgatagattagctaaaggccagcatggcaatctgtccccatcatgtgtcacaatggaatccaacccatatcttgtatccttgtccgactttataattgctacacttctgcagagaggggaaaatagttggcaattaaatcagacgatgacatgtgaacatcaggaagccttgaatctctatcaagagatcatcaaatttcaagcagcattttttcaaaactcagaagtttgcatgcttcgcagctcaagttagatgtcctcaattttcatgtcaaagttttgatatcttgaagttaatttttggctttgtaaatcttcacgtaaagaatgaaactttcagaatgatttcatcaaataaacaaaaggaaacagaatgggcaggttctacttttctgtgcggctggctgcacaatagatagatcctcgcacaaactgcaagtcaacagggaaggatctgaatgttcaaattctacttttgcagtttgcgcggctccctatcttaatttatcatgaaaaggtaaataagggaagcatagtctaacataaaaaggtaaaagaacttgttaagatctatcaaaaagtagataataatgtttccaccacatgaagacataaatttcacacacccactttttcatgcttgtttacacgactgtagctcatgttgtgccaggtagatggaattatgccagttccagagtaacattcataagttggttaagattctaaaatattttcaaacactgtcaacaattgaaacatttcatgcattgcgtaaatgtattagggacaacgtagaatgatatgcttgaccaccaaacatagcatataacaaaataaatgttacgcggcgccttcctgagattctttggaagggcgacgtaaggctagcaaccgatgtcagggcgattgctgtccgccaaatggggtcccctccgtacgctagactagattgtcagtgccgtacgggaaaaccaatgtcaacaattgagagaacagtaatgagaattgaatgaaagccttgattgcattaatgaaagctaatacaaaagtaggtaacacggtgtcgagggggagagcaccagtacagagaattgcttgctagaaagtttcgaatgcttgatccccctaataatgcttaaaaaaaataaaccaaagttacaggaatagacctaactaagctagaggatcataatgaaattacaaggaataaaactactttatatttacaaggaaaaggacttagttttctacaaggtagaaacaggtccgttgtcagcaactttgtctcaggcatcacgatctgcgcgcgcggcgctgttggcagctgcttgcgtctgggcgctagcgagggatatcggtggggcgacagaggcacatgcgcgcttgtcacttggcgcggcccagaccacggagtcgtccgtggcgctaggcgttaggaggcttgctaggacgccacagggcgcgtccaaggggtcatgaggcatggctggaaagccgcccatgacattctcccccacctgattggcgacgtcctcggcgccttacttgcaaataatcttcaattagactcttgtaggctttgaggtttgttcccctctcccaagtattctcctctgcgtcacacccttgccattttaccaagaactcttgatgatctttcctgaggcatgaataacccatcatcaagaatgcttcagccgccttttcccgttgaattatggcctcgaatctgggtatagtgagctggctccttgaaggatcctcagtgtcttcccgaaaaggtttcaggagactgacatggaaaacggatggattttccaccaactggggtatccacccggtatgcaactttcccaatcgcctttcaatggacaaggtccaatatatttttgcaaaggcagggtcatggacccctgcaaataagtaccgctttgggattttgaccatcactttgtctcctcttggtattcaacaaagcgacgattctgatcagcatgcctcttcatccgcttttgggccttacaagatagctccgcactatctccaaattttgcttccatcttttgaggaacgaggagattttgacatgtttggtgcattcactgtgtgtgggagtagcggttgctgccggtaacaatttcaaaagcgcttttgtttgtatgagctcttttgtgaattgaaacacagttgagcagatccagagcttaacccaattcttctgcgatccggtaacaaagtgcggagatattttcaacataccattgaaccgctccgtctggccatcagattgcggataaaaacttgagctatgactcaattttgacccgaggcacttaaagttgggtccaaaagttgctagtgaagcgtgaatcgcgatcactaacgatgtctttgggcaggccccaatatttgacgacatggagaagaagagtcgagatgtatttctgctgatatattgtgggctgcaataaaggtgcatacttggaaaaccgatccaccataatcaagatagttgtgagatctccgaccttgggtaatccggtgatgaaatccagagacacgctttcccaaggcctctttgggacaactaatggttccaaaagtcccgcttgtgtcaagcggtcagacttgtctttctggcacacaagacaagtactaacatactgagtaacgtcgtcggccatttgaggccaataatatgcacgtcgaagtagggccatggtgcgctcctcgccggggtgaccggcccacaaagtgtcatgacattctgccagaagagtccttctcagatcttctcctttaggaacataaagtcggttccttttactttcaagaaaccatcctccatgtagaactgacgagttttcctgtcctactagatcaaccaaatactgtgcagcggatccttgatgattagatcccgtatttggtcttttatggtggtagctacttcgcttccccttagggtggctagtaggcacactgatgctaggtccgctctccgactgagtgcatcagccacatgattggtcttcccacttcgatattctaagttgaagtggaattctgctaggagttcctgccatcgggcctgtcgatcattcagctttggctgggtcatgaaatgactaacagcagtgttgtctgtcttgacaacgaacggggatcccagcagataatgcctccaaaggcgtaagcaatgaacaacagccagtagttctttctcatggacggcatagcgccgctctgcatccttcgcttcctgctctcgtatgctatgggatgcccgtcttgtagtaagaccccgccaagagcatagttggaagcatccgtttgtacctcgaatggcttccaagtagggccaatacggggctactagacatagccgcttataatgcgctgaaggcttctgctcgcctgggacccaagtcccaaggtgtgatcttcttgaggagtcctgtcaatggcactgcaatgagggagtaattcttcacaaatcgccgatagaaatgcatagtccaaggaatgccctcaaggcgtggatatccttgggtggcggccaatctatgatagcttggatcttttgctggtccatcttgatccgcccttcctcaatgacatgtccgaggaagtcgttctgttttgcgcaaaggagcacttggatagctttgcgtatagttcatgctccgcaaccgggctagaaccttccgcaagtgctctaggtgttcctccagtgtttggctatagaccacaatgtcatccagatagaccaccacgaattcatcaatatactctcgcaagacttggttcatcagggtgcaaaatgtggctggagcattagtcaagccgaacggcatgaccaggaagtcgaacgacccataccttgtcacacaggtcgtcttgtgttcatcgccctcagcaatccggacttgccaataccctgtcttcaagtcaatcttcgtgggatttggagggtacaatgatccctgtgtctagcatctccgtcaattgtctccgaagctcggtgagctcgggttgtgacattctatagggcacccgggcaggtggcttcgcacccggcaccaactcaatctcatggtccacagtgcacctaggcggaagtcgctttggcatctcttgtagcatgacatcttcaaattccagtagtagctccttcacgggtgtagggagttgacccgatgagcgttctacttcttcgatgcataggatagccaggaatgtaggttcatgtctcttgactccctttttcagttgcaaggctgagatgttctcagcggcatctttatagatatgcacggaataatgcagggcgtggcccctttgctcccatcatcaaaagcatgtccgcatatggtacgggcatggtgttggtctgtctcaagaattccagcccaactatcaactcgaagtcatctatgatcactactcgcaagttgaactttccttcatagggaccaatcttcactggtacctctttggctattccacccactggttggggaggtgagttgatagccttgacatgacctctgcccttccccacaactataccaagacgctccacctgagtcaaggctaagtagttgtgagtagcaccgtgtctatcatcgcccgaatgggcttgccatttaccttcagctcaacgaacatcaaggtctctcttgtgtaggaggattccctttattcgtcttcttcttcctttcttggtgattgcgcaggggtcctttttcttacggataccagcactggttcccgctaatgcctcagaaatagaaccaacaatcgcattgaaggcaccgaccggttcggtcgtcccctcatcatctgtctcgtcgtctattccatcatcatatagcttggtgggcattcatctgtgcatgtggacatttattattccaatgtggcccgccgcagtggcggcatcctgaagggggctttcttccccgatcattgttgtttgatgcagcactgttgctgcctgaggagggagccttagttttggatgcgctccgactccccatttctgttagggccgccgttgttagactggccccctttgtaacccgttcgaacaggcggttgcgtcctatccttccgagcttccatttgatagtcccctaggcattccgctgcttggattgccttggtagggtactaccctttgtctttgcagctccatgctggcataaggtttcaacccttctaggaaggtgaagagcttgtctttgtccccatgtcgcgaatgttcaacatgagtgcggagaattctcgcacgtagtcccgcactgatttggtctggcggagctcccgtagtctccttgcattgtactcaacattctcggaaagaactgtaggcgtatggctgccttcattcttccactatctccagagcatcttcaccggccttgatggcttcgtacttcaccggccaccagagcttagcatccccctgaagatacatggcagcagttgctaccttcttggcttcttccaggctgcccacagcatcgaagtactgctcgatgtcgaagatgaaattttccacttctttagcattcctagctccactgtatggctttggctcaggaattttcatttttgagccatgggagccatgttcacagcaccccgattgagtttccacctcctcgaagcaagccttatagagcagcattgacaacattgagctggcctgtcaagtcgtccatagtttgttgcatggcagtcaccctgtctgcctcttgggccctataggccaaatccttggcgcgctcatgttggaggccctcgaatttatcaaaaatttcggctgcctcagtagctgccgtttgccggtctccttcagagtcgcgactgatgttttctatgtcaacttcagcctgcgatccaggtcatctaacctttgcactaggctggtctgtagttccggcaccgtattcacaatgggtcgtaatacgtcaactgtctcctcaagggccgcgatgcggtccccatgattcaccatggtcagaaatggtggtaatgtcaatgcgttccctcgtccgatgtcgagcctaggctctgataccaactgttacggggcgccttcctgagattctttggaagggcgacgtaaggctaagcaaccgaagtcagggcgattgctgtccgccaaatgggtcccctccgtacgctagactagattgtcagtgtcgtacgagaaaaccaatgtcaacaactgagagaacagtaatgagaattgaatgaaagcttgattgcattaatgaaagctaatacaaaagtaggcaacgcggtatcgaggggagagtcgccagtacagaaaattgcttgctagaaagttttcgaatgcttgatccccctaataatgcttaaaaaaaataaaccaaagttacaggaatagacctaactaagctagagaatcataatgaaattacatggaataaaactactctatatttacaagaaaaaggacttaattttctacaaggtagaaacaggtccgttgtcagcaactttgtctcaggcatcacgatctgcgcgcgcgcattgtctgcgcgtgcggtgctgttggcagctgcttgcggctgggcgctagcgagggatatcggtgggcgacagaggcacatgcgcgcttgtcacttggcgcggcctagaccacgggtcgtccgtggcgctaggtgttgggaggcttgctaggacaccacggggcgcgtccaaggagtcatggggcatggctggaaagcctcccatgacataaataaagacatagaaagacaaattttacatgaaatgtttcctagaatgcccaaaattatcatctatgagcagcattggttagaatattgtatcgttagaaaaaatagaattactttctagaaattcaaactatgatgagtatggctgttcaagcattttatttaaactagcgaactccgttgttacagcaatataaaatgacccaagagaatatgtttttcattggtaaacttgttttaccaagaaccccatcacataaactgagatccaacacatttcttggtaacaagcaatccatctgtttattcacatacatgttcttcatagaagcaaatagcaagcccccgcttgccaaaaggcaccatcttatagcagttcaaactgcaaagaaaacacaatccaatttttgcattcaaaggcaaatatcatctccaaagaaaacttgtgtgggaagtgcatagcacaaacgctgaagcctgttttcctttctattttgactgttagtctttccacttttataacgtgaatagctactagcataatagctggagtctggagatacagtaaaattaccctttaaaactatatacagataaatgactgaggattcaaccaaatgctcaacctatactgatgttggtcctttcttctttaactcagtaaatctggaatatcaccagcgtcttttaggacacctgccatatttttgaccaatttatatatctcatcagtctgttcatgagcattatgctccatatagaagaaatgtgtttgtctttgcacctcaatcatgctataaccaggctcctttttcacccctgagtccttcatcagtctccttacctccgcaacattgttccacaaaccaaaagaagcataagcattagacaagacaacatatttgcctgcattctcaggttccaagtcaaagaaatttctagcagcaagtttgaccatctcgatatctccatgaatcttacaagcccctagtaaggcaccccataatacagggtgctccccacaacgcgagtttttgacaaactcatgagcctcttgtaatcttccagcacggcctagaagatccacaatagctgcataatgttttcctcttggtcgaagcccataatctctcatcatcaatgaaaaatactccttacctttatctaccaaacccccatggctacaagcagaaagaacagcaagaaatgtaatatggtttggcctaaatccttcatctatcatcctatgaaatgattccagaacatcttctattcttccattttgtccatacccagatatcaaagcagtccacgttatcacattcctttccaaggacttactaaacacaagatagccatcagatggacaactacacttgaaatacatgtccataagtgcactattaactacaatatttccactaatttggcttttaatcaacagcgcatgtgcttgcttgccctgctccaggactgctaaagaggcacaggctctaaagactgatgcaaatgtatactgatctggaagtacacctctttgtttcatgttatggtagagactcacgcctacttcctccatacccttctgcacgtatcctgcaatcatagcgttccatgaaaccaggcatttgaattgcaacttatcaaatataatgtgtgcggtatccaagtctcctgcttttgcatacaaaattaacaacttaatagtcagatattcatttggaacaaagccgacaataatcatttgccaatggactcttttccctttcttatatgcttgccggaaaatgcactcctgtaaaagaagggaataagtctctgcctcaacctgtacaccagagcggcacaatattccaactgcttcagccacccttcctgagaaacagagaccttttattgtctcgtccaaatagagggagctctttacgccattggcctgaaaactgggaatattgccaaccatgatttcaaattcaaataccatcagaataacatggtccaacttttgcttcctctacatgagagagccaaagagcatggagatttcaacacccagagaagagagcaaaggaaacagcaaaaagccgagagcagaacaataaatttagaaggaaaaaaaaaggaacaatcattcaacgagagagacgaaaggttgagtaacaagcaaaattcatcgactttcaacatctacgaactgcaaagaaaccaagtccacatagcagaacggacaattggcgccttggagcaacgaaaatttagtaagcaacagccttttttttcaataagttccaacaacttgctaatataaacaccaaatataaagcatactaagaaccgagcaccctcattgaagatgatataaatgactaagtcgggactctggtgttaaattcttgcccaacaaaacattatatttcgatgcatcgtagtccgtgttttatttttaaggtacatatggtccaacaagctcttagaatactagtcaaaagtcctacttgtataagttctctaaagcttgtgtgtaaagtgaatagctaagtacataaacagattcttaagagctatgttgcacgcactctccgaaatgtagccgcacccgtgtcggatccttcaaaactgcactacctttggaggacccgacacatatccagccacaatttccggagagttcgagcaacatagcttaagagaggcagtcaaacaaatagtacccctttcctccaacagattaatagtagtaaaaaaaaaaggcaaaaagaggtttttaccccgagaacaaaaaaagtcataaaagaggtgcaaaaatataaaatttaaaatatgcaaagcatttcatcacctataaaactgaaatgaaaaccaaattagaaagatattgagaatcctaacctgccactgctgctttcagactttatcctcttcaaaagagtagtagtttttccagcaaacataggacccacaatcacatgaacctcacccgaatccgaacccgaacccgatacatcagtatgcaagacccgaatttgattatggtttggcacagtagaacagctaaaggaagaaactttattcatggggtttattgtttgaaccccatatcttctgcatacaaaaatgggttcttgaaaatgaaagcagaaagataaaggaggtgttgtgggtcttgaaagtattgggtaaagtagtgatttcattcttgataatgttagcatgtagtagtactagtaggagtatgaaattttgaggcttttggagtagaattttttgggattttatcacatttgcaggtttgattttatgggaaattgagttaatttgatgttagaatatgagataagaaaagggggcatgggttttatgggttttaacttttaagggttttaggttctttggcttggagggaagttcttcaatagaagaactgaagaagaatagcaatacataagctgtatacaaggttcgacttataaatcgcatttatatactgcgacttataagcattttataaatcatattaccgtttatcagtttatagaatattttacacccccaacagttctttatcatctagatattatctttttatcttcttcttaataacatgatatttttgtaatctatgttatgaatttacttataacgataactgttattttcgaagaaaaaaagtaaaaatagtaattaaacatagaagtcgagaaataaatgagcagaataaaaagttttagaataaaaattgctcatgtcggttattttattaataacaatgagtgttactcaaaaatttatttacacaattgagaataaaaaagagagagaactttgtaaagatatacttaatgcaggtaatgcaaaattaattttaaaatttaaggtagattttataatgggtttctcagattatttatttatattttaaatgaattttgtattgagataaatttctcaattcatttagtattcgtttttgtttttagtagagcctcaatattgatcgagcggactcacatttcaaaatatttttaaaaagaaggttcaaatttatgcattttacttttgattatggttttaaagttatatatcattatacttcaagctcgaactccgttaggtcagggtatgaatatccaaatgtataatatatgataaaattaaaatattttggtaaatactatgtgtgaccttttccaactttattagttttaccctaaaatattcaatattagttaacaataatttaatttgctattggtggttgatgcaatgtcatttaaagcatttaatatcatgataaactcagatattgtatctattttactcgatatcactaagtaataatttttttattattaattgttataaatagaattctatttagagtgaatgtctatcttttagagagttttactttgtggctaagtcattattattgtaaatcacccaaaattcaataagaatctctcttctctttctctgcagtattgttcttgttcttttattgcttcataacacgttatcagccgagactataccgtctcaagaagctctttgagaagattaaggtataacttttctcctctctttctttttaattatgactgacttatgaaagaaagttcgttgctcttgaaatttcgggtaagaactatatgacatgggtgttggatgctgaaatccatttagatgcaataggtcttggtgaagccattaaagataaaaaataaagcatttacccaagactgtgctaaggccttgattttcttgcgtcataacttgatgaagggttgaaaatagaatatctcacagtcaaagtccacttgttttgtggaatggcttaaaggaaagatatgacaacttaaagttggtcactcttccaaaagcacgatatgattgggctcgtctgaggctccaagactttaagtttgtttctgaatataattctgcgatattcagaattacttctaaattgaaactctgtggagatactatcactgattatgatatgcttgaaaaaacgtttacaacgtttcatgcttccaatatgatcttgcaacagcaataccgaagagaaaggtttcaagaagtactctgagttgatttctcttctcctcgtggctgagcgaaataatgacttgctcataagaaatcacgaaaatcgacccagtgggtctacaccattgcttgaagtgaatgaggtgtattctcattattgccaaacgtgggaaaggttgtggccctattaatggtcgtggtcgtggacaaagaagaaattttcctggtgttaatcaccccccaaagaaaaataaccaccaaaagtggaaagggaaatatgaggaaggcaaaggcaaatggttcagaaactgaatgttatcgttgcgatgagaaaaggccattgggcaaaactttatcgtgtaccaagacatttggttgagctttttcaagcatctctaaagaataaaggccctgaagccaattttgtctctgacaatgattttgacatcaccgaattagatgtggccttttcattctagtttgattaataattttctttcgctaagtataaaaaaattttttcatgctaaaaataaattactttttaattcagtacttaaattattcatcactattttattcaattatcatcaatatatcttggtaaatgaaaaatttctcaaataacaattgatttgatagtgttatattgaaaatgtagtcgtcgaaatatgcgtttggtagcgtatgtcccatatttaagaaaaaacccgataaataaccgaaaaaatcgaaaaccgacaaacttgacttgtgacagtgttgtttgctcctaaacaagtgttcattctatggctagcattgcttggtaaactaagaaccaaagatgttctattgagttagggtattagtgtacagtaataacagcaactcagttaaattttactagtagagtctggggaagatagtgtgtacgcagactttattcctactctgaaaggttagtagactgtttctgaaagacccacgactcaagagaacaaaagacaaaagaagactgaggcattagaaacctcttcacatatcttttttgaatgtctttactcaagatctagggcagtttattaaaagaaaaagaaaaagaaaagaaaaaccatggatatcatgttctcgaggatgtttggattgacctttagctggtcaaagcagcttttaagctctttttagcttttttcagtgtttggcaaaataaaaaaatgcttaaataaattaaaaactgcttaaaacaagccaaaagcaagaagactgaatgtccttactcaagagaacaaaaagacaaaagaagattgaatgtccttactcaagatctagggcagtttattaaaagaaaaagaaaaagaaaaagaaaaacccatggatatcatgttctgagggtgtttggattgacctttaagctggtcaaagcagcttttaagctctttttagtttttttaggtgtttggcaaaataaaaaatgcttaaataagttaaaaactacttaaaacaagccaaatgcaagaagttgagcaatcccaacttattgctttttgacttaaaagttatttctactgaaaaattaatttttttaagccaatctaacgggctcctaatatgacacagaaatgacatagcaacaattaaactgtctaatagaaataaagctataaaatagaaagggatagatgacatgaacaatttatcattctagttttgaattggatttagcaaaaaatctatatatcggaaaagggttcaaaatgcccctaaactattggaaaaggttttaaaatacccttcatccatttattgggctaaaaatacctctgcatccatttttcggttcacttatgccctaatgctaaattaaaaataattattattctttttgtaaaaaaaaaaaaatattttgcaaaatattttcgtttttttatactaatgcaccaatagtccactagcttttttaaaaaacaaaacatttttttctttaaagaaaactgaaaaacgaaataaaacgaaatgctttagaaaaactgaaaaaaatgaaaaaaaattattttcaaaaatgaaaatttttgttgaaaatatttttttcagttttaaaaacgaaatattttattaaacatttttttttcagtttttacaaaaaaaaaaagcttaaaaactgaaaaaatgaaaaaaactatatttttctgtaaaaactgaattgtttattgtaaaaattgaaaaaagaaataagaagactttactaaattagtggactattggtacatcagtttaaataacaaaaatatttagcaaaatatttttttaagttttagaaaaagaataataattatttttaatttagcattaacttaacggtcaaagggcataagtgaaccaaaaaagtaaatggaggagtatttagcccaataggtggatgaagggtatttttaaacctttccaatatttagggacattttgaacccttttccgcatattatttaactaaattcttttccacagtcagcaaatgaaacttaaattaaatatgttattagggtggtaaggaatatttatagttaccaaaaacagaactaagatctaaaggagatttattatgacttaactttaaattccaatttatgaaatttttgtagtgatttaattagctttaccatgtgatttaatcattcttcagcaattgtatccaaaagcctatccattatatgcattgaccaacagttggcaaaaattcatattcaatgttcgaatcgaaaacgttactgttaggcgaaggatcaaatcatagagatagcagatcttaagagacggaaaaaaaggaacctcagtaatctagagatcgcagagtctagtcgaatcacgaaggataaagcgatttcatattcaatgttcgaatcggaaacgtctaattaataatgaatgagtatttgtcactcaccaaatatctatcatattaacgtaggtcaaagagaaaagcaaaaccgaaagaagaatagtcagtataaggcaatatccaactttctttattaattaatttcctaacgcaaaagaaaaaagaaaaaaacaaagtgcgtaaattacggtacatttcttggtcaccatgacattatctaggaattacatgtcccaagtaaattgtcggaagttcccactgtaaattagaaattgagaagaaaaaaaatcccagaatgttttccttttgacaacatgtcaacgtttttattttacaaacatagagaaacctatttaaagaactttttaaccatttttccctttaatgttgggttactttacctataattaatatgcaaagcatcggtacaatttcttgtgttataggttgacgaccatattcgtagaaataagaaggaagaaaattcagaataaagggtatttatggaaataatctggcttccatagtgtattcactgtccttaaggaatttagacttgtcactaattgctgtagggataatagcagaattcctctaggattttacaaagccttctaaattcgagtttcagcaattaactcgaatttctgacaagaacagaatatttgtgagttagtagaaaataagaagaagagaaagagatggaattttttcagatgatttcttttggagaagagataggtatttataatacctcaaggagtctgttggaattaacagaccatctcttcataacatgcaccttttaaaacctatagtcaccttcttttgaatttaaaaaaaaagttgttcaaaacgttttaattaattaataataggtgactaaaatattaattatacgctacttaattggcccaagggcccaatcttgactattaataatatagtcaaatttcaatttccctttgtttgcacaaaaaatatatcaaactttttgttaaaccaatcaatgaagaaagcggagggttaatcctaatcaaacataattaactctagatcgaaccataataaacatgaactccgaatgaaatcaagtttacaaaactcttttgatatttacaaaaacgtaccaagcgtgaatgataggcttacatctttgatgcattatcctatacttgtaaggatgaaggaaggaagaatattcttggtagatactggatcaattgttactgaatcagctgcggaggcttcttggggtattcctcctagatctcggttgttcccttgttagcgatctctttcaatcttctgacccagtgttcagatttcttcctcccagcccctttctggtcttctaacctcttatttgtacttccaatgttcccgtttgttcaacggtccttaaccagcgggttctcccttgattatgtttttcgttcttcccctttgctttacagcaggtgctccaccatattaacccatcattggctcgatctcggatatggtcgagacgcttattggggtcgtatcttacgaacgtaagcacggctaagtcgatcccttactgcttcctttagcgtcgaccttatggacagatttcgacccatacaattagtccctccgcccgttgaggtcgcctctcggcgagttcgattagcggactgtgctaatttgaaaagtgagaaatctgtccgccctgtatcgggacgagagcctcatggcgagatggtgatattacgatccaggaaccgcatcagaccgtcacatcagttcgaaatgggactatcacatcaatctcagaagtcagagatgcgggtgtcattatgaggcatgatcctcaggcggcgtatcgtttcccgtgccttttcagttttcttcctttgattgatggctcttggctttcccgcttctatcatatgtaacactataaatagacgggagtccctcgtttgaatgttactttttcaacctctttaagaaagagatatagcaaactccttccttttctatctcctcggattcccatttctgcctgaatttgtggtaatcactgccctctctcttcactgctttcgtttctttagaccaaaacaacaaatggacaatgcttcttctcattctaacagggttattggtgctccagtgtcgaaagatgatgtatcccttcttgaggagggagtagaggtggtggtagacaaagggttctcgtcggtggatgaggtgattcctcgtcccggaaaggcgaggatcgattttaatagacttgtcaggaacaaaccgatgcccattctctctaccatgaatgaagctgcgatcgcgacgctcaaagccaggtgggatatcccggctcacattgaaatagtgtcggcgggtggctatatagtgcatctacatcgcccgggatacaatgtgttctatgcgtatccctttgtcgttggtacacacttcctctgccttctccggtggtcgatttctgtcggttttatgaagtgtgcccggctcagctctccccatatgcgtacaaaatattccttatgctgatcaagtttgcggagctggccggccgggaaatttcccttgggcatatgcttcacatctttgcacctcacattcttcggggcacgatgattcatctgcgccatcgagggaccaagagcttggtggtgaagatggacgataaggctaatcgcagtttttgggaaagctatttttgtgtgcgaacggagtatttggttgtgaactcggcggggtttccagagacgtggaactttgctcgtaagcttttctctgattacttcgttttttttatttagggcaatcattgaccgtctctctatcgatgacttggatgagggtttgttttgcttgcctattttttattttttattttgcagcggaaaggtaacctcccccgctagtggacgacatccgccagtgggtgggcgcaatcctctcccatacggtcgggattcatgaatgggcgtcctttcatgagaaatttgagcacaaacctctgattggtgagtcggcttatggttttatccttaagccctacaccgttccctttatctcgtcgttatgagatctaaccttttttattagcaggtcggaaaggggcgaaaaggtcgagggctccccgctagcgttccgccagtcggtgacctctgtccggcccgcaccggtaacttctatgggcgaaggtacagggagcggggctgctagtcgaaccgcccctgtggccgaagctgtacatttggaggttgctccctaactggagactccggttccagtagttcgctggtcgggcgaatcttccctccgtcggcagtggagaggccccgtcgaagaggcggagggtaatattggaagggaccccggtagctgagacgtccttgagggacgaccctgcttcgatggttcctgaggtcgaggacagggccgaccaggaggtggaagagaggcttgtggcgagcgatcgggaggctagcgtatcagaggcatggggtcccgaggcggccgtgatcattcatagcagaccctcatcatcctggtatagtcgtacccctccttcgagtgaagaaagaggaaaaggtgtcgtggtcgaggactacgatactgaatccgacatcgaccccgaagacataaggatgttcgtggagggctttaccaggactatgataatggcggaagggccttcccgtatacttgagattccgtcgaatcttaacctgcaacaggatacggtggagttggtgccgcagttcaatcttctctattctaccgctgagagtggagctcttcaggcggccagtgattctcagttgtcgcatggtgtagccgcgatgggcttaagggtatgttcctttgccatctttgatttgtgaccatttacctttactaatcctttctccccctttcgcagacttacatgctggaagttggaagtgctcgtagggctgagacgcgggccaaagatttttcagaaaatgccgagaagtatcaatggtatcataacagatgccgagagttgcgtgagaggcttagagaagatgccagtacccagtctaccagggaggagttggagagaatagatggggatttgatgcggtctatccgcaggtgcagtgagcttgaagagctgcttcatgccaagaatgaggagctcgaggtggtcaagggggtcaccgcggagtgcgaggaccttcaggccagagtgcggtcattgcaagatgagcttgaacagagtgctgccagggtggacgctcttagtttagaatgggcagagaagctggtcgaattggaagggaaagtggtcgtgttggagaaagccgagcgtgctcgagagtcagctttggcgagggcggcggcactagaagacaccatccgcgtcctcaggcccgagcaagagtctgaaagggcgacagccgcaatgggggaggccaggctcgaggagcgcattagtgagattgaccaggaagcttcaagtttgggagaccaggtcgtggccctcgagggtgagaaggcgcgcctgttgtctcgtgaatctacctatgcctccgcccctcgccacttgcatgagctatgggtttacgctgaggcccaacaactatacaagggtttgtgggaggcgggaagtgtttatgaggcttctactctctgagggcacgcgaggcaggatcgtgtcaattatggttatgaccctgcgttgctggaggttggtgggagtgctgatgttgaagacgggcttcctgatgacgataatgatgatgacgtcagtggagatggcgctgagtgagatcgttgttgtagctttctgcttagctttccttttccctttttttatgtggtcttgtttactttcgtttcttccccttttcccctttttgtgggcctgttctggccttttgtaagatgcagttgttgcgcatgtatatttgaatggaacgattgctctgcctttatttgtgtatatcttcttggtttgctttcgattggtgtttctttcgctgcatacttttgtgtggactttcggactttattgtgacgagtccttgatccttctagttgggaatatgacccgcccgctcaagcggggtgctcgttatgtgagtcagactgtggtcactttgtacctgcaacttcggtcgaggctgatttatgatttgtgctgttttatttcgttgtggtgttgttcttggtaggctgatcatagaccgactcggggatgaccttcaggctggcgtaggaaagttcgagcaggtcgaatgttgataattcgagcgatgttatatgtagggtgtggaattgtgcaggaattttgcatattgttttgttcatttggttcattggagaatgtttacacattctgtttaacatatgcatttgagaagttctccatctgcctagtcccttcatcggtcaggctggagtagtgataggcggagcgatgaataccctttcgaacttcgaggtgacccctttatcttggatgaagttggtttcgtcttgtacgttcgaacaatatcgaaattagacaattttcattgggagacggccggtgagcgtaagggtatcccaacgagcgagctcgaattgagaactccttgcaatagtcaagagaggtcgagctttcctttaatttgtcgatggccaatggccgtaagggggttatttcaaacgaggccgaaagataacccattgcaaagtcgagcaaggtcgagctttcctgtaatttgacgacggccaatggccgtaagggtgttatttcaaatgaggatgaaatgataacgcattgcaaagtcgagcgaggtcgagctttcctttaatttggtgacgaccaatagccgtaagggtgttatttcgaacgaggccgaattgataacccattgcaaagtcgagcgaggtcgagctttcctttaatttggcgatgatcaatggccgtaaaggggttatttcgaacgaggacaaaatgataacctatcatattatctttttgtatccactcgtcaccgtattatttacgcgtgtactatagcgagtcctgcccgcttagttttactttcattggagagtactgtgtttcgtgggcgagccccagttcacattattttccttttattggagaatactggcgcctcatgggcgagtcccagcccgctaaattttacttttattggagaatacgaggcacctcatgggcgagtcccagcccgctaaagttttacttttattggagaacatggggcgcctcatgggcaagtcccagcccggtgaattttacttttattggagaacactgggcgcctcatggccgggtccctcattggtgcagctccgaaagtgttcacgtccctgtttcataccgacagaagaacgtgataaagtcaaaacataatgaagttctattaccttggccccgcgagctggaggaaggagggattgtgttgcacggccgcttgcttcgctctgtgttcaaatgatggttccaggtctggtggatgtacttggcctcgtcgttagttgcgcccgggttcctcgtgggttggaatctttgacgcacatttgctcgtcgggatattgaggtcgagtcctagtctgaatccgtcagctatgcacaataaggaaaatatgtcatactctgttcacaaatcacccagtatatgcggtacaaaggggggacaggatgtgcctgctatttcaagggatcacacaacatgctatagtcccttgctaagaggcagaagagcaggccggcgtgtaagacgaatacgtcgaacaggattacggttatgccaagcgcatggcggccgtgattccgctttcaccatgcatatgacgagcccaacttattgtcatgcgaagatctaacctagattagattggttgttttaactacttgtcgtttatacatattcttggttggttttgggatctaggggtaactagaatttcgattagaaatccctacagacggggcaaattatttgcacaaaaaatatatcaaacttttttttaaaccaatcaatgaagaaagcggaaggttaatcctaatcaaacataattaactctagatcgaaccataatgaacatggactccaaatggaatcaagtttacataactgttttgatatttacaaaaatgtagcaagcgtgaatgataggcttacatctttgatgcgttatcctataaaggaaggaagaatacttcttgatagatactggatcgattgttactgaatcggctgccgaggctcttgggttttcctcctagatctcgattgttgcccttgttagcgattctctttcaatattctgaccctgtgttcagatttcttcctcccagcccctttctggtcttcttatctcttatttatacttcccatgttcttgtttgttcaacggtccttaaccagcgagttctcccttgattatgtttttcgttcttcccctttgcttcgcggcaagcactccaccatattaactcatcattggctcgatctcggatatggccgagacgcttattggggttcttacaaacgtaagcacggctaagtcgatcccttactgcttcctttagcgtcgaccttatggatagattttgacccatacaccctccaaaacaccctaaaatattcaaactatataagacaaagaagttcttttaaacacctcttcctttctttcttttttcgatgagggacaaaacaacctcttctcaaatactctcatcaaacactaattaatctaacacatgtgggtgggcgtcggccggttcagttcggttcaatttttatcatgttcggttcggtttgttcagtatttatttgcatgtggcaacaacaaaatgaacctcttgtatcatcaattttttctccattttagttttagttatgtttactattgagtgtacgaataaagtttcacattggcagataaaaagattaagaatatacacataaggtatagggattatttaatgatgtgaaacctttttaaaaaaatctgcaaaaaaaactaaagtggatataatatcacatattaagagtatctacggactaattgagtccaacatttactaatacttttaattagaagagcgaggattacttagttgaaaatactttatgatgatagattcaagttatacaaaaggcaaatgaaaaatctttataaatatcctaagataatgcgagggctaaaaaaaggtgttgcacattaaaggattctgttgtgaccttatgattaatacagtcagatctctttataacagcaaccctatataaccaatacttttttataaaagctaaacttttttagaattaatttttatattatgtcattatatatgttttatataacaataattcgctatagcattcaaaaatattcggataaacaaaattgttatgtagaggtttaactatataacaaacaaacaatcacttattaattagagttgtgttggactaataaatattttttttttattagatgtatcggatttgaatcttggatatgaaagtacctttggtaagaaaagttttatttttcaatataatattttttcgcacgaatttaaatttagtcggacaagagcaacgaacattaaaaaaaagcaagcaatcacctaaaatagttgttgacttgtaagatgagaaagtcctaacaatactcagaatttaaaaggaaaacaaaaaggctgccaccaattaagaaggaaaatgatatttgcatgtatagccgctgtaaaaataatagtcgaaaaaatacataaaatttataatttttttatattttgtatattatatatcaaaattatataaattttatacacttttcggctactaaatataaataatttgtgacacggactgaaagcgataatatccggattaagaaggagaagaaggttggtaagtgagtgtaaattggttgtcattttgagtttcttaaaaaaacattaacaaagctgtgtttcttacaatgatcgtccgtttgtttcctcatccatatgtattttaattaaactaatataaactataaaatattcttatcgtattttgattaaatccaagtctacctgtatttttattcctttttgaatataatgaataggcaaacaaggaatccaatctgtccaacacacatttcccacttagttcttattttttatttcaaaaagttgagataaataagtgagtcttcttcttgaaaattaaaattcttatcttgatccaaaacgctgttgaaaagccatttctgtttttaaatattgtcgtttacacttttctatttttctttctatttttttccctttatattatattaatatataatacatgcatatatatatatatatatatatatatatatatatatattatatataataatatatatatatatatatatatatatatatatatatatatatgttgagaatcataagtttcagaacactataattttttctcattcgtcaaagcttaacggataaagttacctaagtatttatgctggtgaaagatagtaagtattcagtgaatatattaagataattcgaaaaccaaattatcaaaatatataaagtaattaagtgatgattcgtatagtgaggaatttattaaagtttttgacgtagcatgtgacttagtccatgtttttgagttgggtttcatgcctttccaccacatgaaggatgttgaaaccttgatataatactactattttgaattattagtttttgagattaatttcatcttgattataggaagcacaaaaacaaaatattatttctgtatgattgttagagaagcagtgcattatttctgccaaattgagaaattagtctcttaaaaatattctcgtgctattaatttgaatttatttaatatccagagacaaaaaatactcgctcttgagaaatttaaaaatagaagtattgaataatctattatattaatgagtctagtataggcctactacaaacataagagattaattttgtcatttttctaatcttaggcaccaaattatatattattccagccttttcaataacacaagatgcatggtgttttttggtttctcatttgacttccgatattagaattcagtttcaattaaatccgaattcgcataaaatctcatattaggggtaaaccgtttcctaacaacagaaattcgaactcaaaatttatgattaaggataaaggggagatgcatggttgattatacgtttgtagatccgttgaacttgtttattctaaaaaattaataacaattaaatttgtatgtggtttaaaggatatgggatttaattcaatacgaatgatctaagaacaacaggtaattaagttaaatataaaataaacaatcaaactaattataatgtgatgatcaagcatgatcttaaggtgaacactgaaattcggccttgatcggaccctcgatataagctcgattgcgattaaagaagagaataactgaaggaaactttgaataatagctgaaagacaaaaaagaacttttattgttttgattgacgtgtcaactgtgtcccaaaataaaagaaactttttcgtttatatagtaggaaaattacagtcctagtacaagtttaaataaggtaaaaatcttcttttttcaataaataccgatccgcagttgatatcggatgggattcaagccgtaatacccggttaagggcaaatattacggttccctacttgtcatgcatagtcgttccccctttttctgtagtatacaaattttgtttggcctaggtccattatttccgtgctcaatcctagatatatcgttcgctcctcccgggttcagatacgaggggtccttcggccttgcttgtagtcacgtcaaactgtgctttcctctcatttccttattggggaatagggaaaaactttgcccccttcttactacctcattaaacgacatcatctcttaatttttacttctgtcactaattattttagtttgtattatattaaataatttaatctaaacattacaagtaaaacgagaacatataaccttgaaggttaaacgacaaatgtaaatataatatatatttacgtataacacacacatatataatatatatcgtatttattgatttactatagacattaagtgcatcaaagtttttgtgtcttatcctgcttaaccctgtacccttgtatgcccatgtgctcttgtaaatgatagcatgatatttgatcattctcataggccgatttaggatttgaggtttatgggtgcatgttgtaatcttaaattaatagtatacgataataattgggtccacaactagatatatatatatatatatttagtgttttttttttatatagaaatacaaggtctatgcaaaagttattgaatacttgagaacacatatactacactgtcatcctacataaaaatttaatttactcatgaaggagtcaaaaaattattttataccaatttattggagttacgtgacaagcaataaatggactgcatatagtttagctagttagtttacctagttgggccacaggcctattattaatccgccttttttgtattattcgtaaataagaggcccaacatataaagaggcctaagggaaaattctgaaacacattagacaaaaattcaatatactgatttctttactcgttcttcttctccattctctctctaaaaccctaatcatggctcattaaaatctgattaatctctgagtttaacatggtatcagagccatgaaattgttgatccttcatcctctaagcttagtgatgttacccctggaggttttagttccttagccatcggagtttctcgtctgttcttcgccgctctcgaggtcgaaattttcttctggtttgttcgtttgctagttttctgctcgattgtgtttaagcgtagtcaatctctatgagacttttacgtttcatccaatcattggagttttttggatgttttcttcgaagctagggtttcagatctgaataatcttcaaggccttttacttctttaggtcgcgaagaagtttgatacattctttcctgcttttacacttctattggatttgttgtgtcaggtgattctctgttattagaaattagttgtttgttttttgagaaattttctgaaaattatgggtgattccagttcaaatactggtccttatgttcctgaacctactagtcccttgtttctccttccttctgatgtcccaggcgtatctcttgtcaccgtgccctttctgggataggttttcgggggttagaggcataatatgaagtctctccgtccgcaaaaaaaaaagggcgttatagatggttcgtgcactaaacttactgagatctctcctcaatataggcaatgggattgatgtaacaacatggttaaccaatttcttatccccgaatattggtgagagtgtacaatattcagagacaactgagagtatttagaagcaaataaataacagatatgggactgttagtggaactaaagttgttgagattaaaagtgaactttcctccacttaccaaggatctctagatattgcctcctactttaataaacttaaggaactttgggatgagctggagattatgcgcaagcagtcatgctagtgcttgtgcttgtgctgctaaagaaggtctccaaaaagaaaaggaagaagctaaggttcatcaatttctaatgggtatgaatgaaatttatgtaggagttaaaagcaatatcctaatgatgcacccattgccatcccttgataatgtctataatatacttctccaagatgaaagtaaagacaattccttccaaatgcacaaacttattctgaatcagcttctttccatgcaaattcaaacaagtttcctcctcaattttcccctcaacaaaattatccatagaaactaaaatttgaccgacctagtcataggttcaattctgatcacaacaaggcttctgtaagaagcctggtcatacaattaaaaaatgttataagttgcatggctttccccagaacttcaaattcacaaaggtaagaagtttggtactgttgctaatgttgaagggcagtcttctaggtttcctgatcatactcattcatatgctgaggattcactggtacctggtttaactcgagatcagtatactcaattgatgagtcttcttcaatgatctggtctcaatgaatcatcgtctcaatttgccattatgggttctgcaaattttgctggtagttcttcttccttgcctgtgtgtttgaatggtaattctaatatgtgcatgttgactagtgtagctagaaggatatgaatagtggactctggagccactgaccatatggcttcaaataaactcttcttttcaacattactcctttacatattccttatatagtctcattgcctaatggttacaaagtaaaagttacttgtattggatctcttactctgttgtcttccgtcactcttcatcatgttttatacatacctaccttttaccataatttgatttcagtgagtaaactcattgctgaattcaaatgctatattttgttcacatcttatttatgtatacttctataggcccattctatgaagtagcttctggagcttggtagaatggaccacgtactttaaaaattctacttcaactaatctacttctgctgcataatccatctctgataattttgacaacattaaacaatatattcctgtttctattgcttctctgattcacttgtttctagttttaattccatagtaaaagtaaatgttttttcattgaatgcaaatgtagatgttctggattctcttcataatcctgtttcattactaacttgtaatagttatcaacatataaataaaaatgatgttctttggcatcatagattgggtcatgttctctttgcacaaatgagaaatataccttctatatcttctagtttgttagcaaaatagtctttcatttgtcatgtttctcttttagcaagacaacctagattgtcctttccaaatagcacttctcactctactgctatgtttcaactaatacatgtggatacatgggaccttaccacaatcaatcctattccgagacaagattttttgactatagttgatgattacagcagggcaacctaacacacctgctgcactccaaaagctatgcctttaccttgattaaggcatttatagcaatggtcaaaacccaattccaacttcccataaaagtgacaatgccttagaacttaggtcttttaattcaacccttcaattcttttctaaaactggaataatccatcaaatcacctgtcccacaccccacaacagaatggggtggtgaagagaaagcacaagcatctccttgaaatttcaagagccttattacttcaatctaaactccccaccaaagttttggggtgactgtgtctcaacaacaacctaccttataaataggtttccctcctcagttttgtccaacaagacaccatttggagttctatatggcagtccaccttcatactctcacttgaaccttttggttgtttatgctatgccaatgtgcccaaatgccctagagacaaatttcaaccaagagcttccccttgtgtgtttcattgggtacccctatgctaaaaaggataacaagttatacaacttgcatactaaccaatcttattctctagagatgtcattttccatgaatctgtgtttccttatcaatggtgtcctctactactttcttcctctaatccacctcttctgttctcatattctcttctgatgttccatctgatttgtccatttctcctcctcctgcctcatctccttctaatgtcattattccaggtgttttacatgtacctgctcattctacaattgatcctgttcagccagctttctcaccacctatttctgaccctgctcaatcagcacctctaactcaatctactcctgcacttagaaagagttctagaacccaccaaataccatctcactgagcgactttgttgtacaacttccttcttctcttccttctccactcattcctcctttctgctgcacaacagatgactgcagataatttagttagttcgtttacctagttgggccacaagcccattcatttaattgatccgttatttttttattatttgtaaacaagaggcccaacatataaagaggcctccgggaagattctaaaacacgttagacaaaaattcaatatatagatttcttttacttgttcttcttctccattctctctataaaaccctaaccatggcttcatcgaatccggttaatctctgggtttaacaaaatttagaagttaaacttataaatttctcgcaaatattaggtggttacatcatgcacaacaaatttgtgagacgagattcttcaaatattatatttcaactcaactacactctataaaaaaaaattttgcctactttgtttgaataaggaaacccgttatcttattctaatacctttttagataatctgattcgcaaacactcatatatttgtaatctcattttaaaatggtaagatgataataaacttttagtgcgaaagacaccgcaaattctatattttaataatcgaataacaattaaattatgtttcacaccccaaaaggattggtaaaaattatgatttaaagggtaagaaaagattctattcaatttcagtgtacagaattttggaaaaggatcacttattttttactataaattgtatgatcactttcattccaatcaagtggtttggaaaaatcaactgcatttgccaaagagtaaaaactttgggctttatttcttcctaactgatgaaataagaaatgggggtaaaaatatgaattgaaaaagttcaaacaaacagaaaagaaaaatgtaagacaattgtctaaaatattgacaatcagtggactaaaactcaaaagtttctaatcattatttgagacacaaatataaaaaatattttttacctaaaagtgaaaacttttagattcaaatcctaattagttggacctcaaggcgaatactatagagctgtgcataatttgttaaataccgaatttattgtaccaaaattgaaattttggtgtttagtattcgatatggtattcggttaaagtttttaaaaaagattagtatttggtatggtatttgatattctaaaataaaatatcgaaataccggtactgtaccgaaatatatattatattacacagtacacatattattaattataatataaataaagaaaactacatttttactttctttaattttctaagttaactctaagcaagtaacaagacattttaattatcaaatatatttctttatgtacagttttttctccctgagttgatatttgttaattttggacaaaacttttatcttcaaatatttttagttttatatttttaagcactttaattaagaaatattaattaccgtaccgtaccgatcaaccgacgaacaccccagcaatactagacacacacaaaaaagaaaaaaacacattgacaatcactaggataagaaacgaaggtactaatgttgaggtaaaattaccaaaaaagaaaatgtttttaattaagaaagcaacatatttaaattcaaaaactacaatttatataaaagaaagtaaaaagtcatcatcttccattgtctcctctcctcttctacattttctctcacacacgagagagagaggatagccaaagagctctctccctctctctctctctctctctctctctcacaatattatacaaaatatatacaaataaatttttattatatatactatatatatatatagagagagtagacagtgttagccatttcagattgtaaatcaatctttcttacaccacactcttcttttttctcttaccttttctctcttcatctctctctctctctctctctcccattttgataataagaactccatttttattgtgttttgccaatttttggtgaatttagaacgtttagagaggaaaaagagagggccttttagccccctctttctatatatgcctctctaaccgatcttcagtattacccatttatcttcttggccttaacatattggtaaaaatttaatgtttgatctgtttattcatgtttgatatttaaagttttaatctttttgcctttttttgacaattctggtttgtgggtctgttgatttttcatgttttatgtttaaaagttttgatcttttagctttgtggataattctggctcgtggtgtgttgattttcgatctgtttaagatcagatgatctcttgttgaatagctgattattatgattattggaatctattgtttagttacatattcttatattttcttttacttaatctgcattttgatgtttcatattgaattcttgattgataatttgtttgaatagtataagctgaagtttatgcttatactgtttgaattatccaattttatgagtttgttgagatcctttgttatgctttttactttgtgttgtgagtgatctgaattttaacacttaagaactcgatctattcatgattatgttttgttcatttttgatgattatgattatgattggtaattttgatgtgtagaatggaaatggagccgggaaaattgtttgttggggaatttcttgggacacgaatgaagatcgtctcaaagaatatttccaagtttttgggatgtggttgaagctgtgatcatgaaagatcggatcactggccgtgctcgcggttttggttttgttgtttttgcagacccttctgttgccgaaagagttgtcaaggaaaaacatataattgatggtagaactgtaagtaacatgttgcgcggtatctggatcattttctgtgctctgttcatttggacttactattaaggaaacataatggttcaaatttgattagctaaacaatccatgtgatccaacaatgaagcctttcagatggcttttccggaaaacaatggttatgctactggaatttagtctaaaagttccaatttttcttgtgatatttatagatgatgacgattacaaaaatttaatgacagatcctagtttacattggaatgatctgttggaagatgtagaaaagttttgcgtgtagggtgtatctagattctagtatactatcaatgaacaaatcgatgattcaataatcaatcttataaaagtttagtatttctacacttagtgtaatagaggctatatgttgtaattgaaggtaatagcaagtgcgtagttgtagcaaaatcgaaccagatatgagctcagttgggttgctttaaatgagatgtacagaattgacagtcaaactcttatatgttaaatgaaaagaaatacaacaacaccaacaagaactatgccttagtcccgaacaagttggggttgacgatatgaatccttatttctttctgtaagctcaaatcatatcatcatcatcatttcatcatcggaatagtacttgaagatgtggacaagaagtatgcctaatgaaagcaagtggatttagttcgcagaatttacgctatgtcaattttatatttcttctggaatttcttaatcaccagtaaacttgtatttgtagcaagttagtgaaaccctgattgattaatgatcgcatatctgatacaagaatgagttttccgcttagggatttcgataactcgttaaatgttactggaaaaaaatgtatgtgtgtttactattttccttacatctccaggtagaggcaaagaaggctgttccaagagatgatcaacacattactagaaacaatggaagcatgcagggctctccaggtcctgtgcgcactaaaaagatttttgttggaggcttggcatcctcagtcaccgagagtgacttcaagaattactttgatcaatttggggcgatcacagatgtttggtgatgtatgatcacaacacacaaaggcctagaggatttggattcatcacctatgactcagaggaggcggttgataaagttctatacaaaacattccatgaacttaacggtaaaatggtcgaggttaagcgtgcagttcccaaagagctatcacctggtccaacccgaagccaatttggtggacagaactatggtttgaaccgggttaacaatttgcttaatgcgtatactcaaggttacgttccaggctcgattggaagttatggagtgagaatggaaggtagatacagtccacttactgctggtcggaatggatattcttcttttaatcctgctgagtttaatatgccaactggcatagactctgcattgaacccaaactatggtggaagtggaacttttggttctaattatggacgtggattcagttctttttacaatgggaattcaaacaggtacggtggtcctgtcgggtttcccccggaagggttggaagtggttcaatgttgaattcagtaggatggaacctgtgggacaatgagagtcttaattatggaacaaattccgccaactctactgattttgttggttctggaagcggggttgcaggatatggtactcttggaggtctcggaacaatttggggtgcctcttcaatttcgggtcaaggtggtggaaatggttcttttggcagtggcaacatcactaacagtggtgaaacaggtggggcagtgtatggacgaaactcgggcggcaatgctgtcaatacatcaccatatgctccagcaaaagacgttcacactgggcttttgggaacttgtatggtactgtaggtgcttcactttatgaggactcggcctggcgttcagcatctccagaactagatggctctgcttcctttggttatggacttgggaattcagactcactcggtcttgttggtggttatagtgttgcaaatagatcaaataaaggtaatgaaactccttttgttgtcaaccttagttatttgttgtgatgtcttttgatgcattaagcaggggtggagccagagtgtgggatgcgcgttcggccgtaaccagtagcttttattcaaaaccctatattgtcttgagaaatccattgaataagtacaaattgctaatttagaaccaataaattaaaaggattataatcccgaactcataaggatcaaatcctggctccgcctctggcactaagctggtgtgtcgtgaaacttgttggcacatcattgctcctattgctttctgtctgcttaagttatcatttcccccttccgtttcacttcacctttacacctatgtctggaaaaggaaagagcgggggttgtgagtaagaattaagaagcgcctgaaaaaccaaaaaaaatatcttcttaccattcatgcgctcaagttgtaaatggtaatcctaatctttgctgcaatctggtagatcgcgtaaatgacataccacgactccacgagctaagctagaacaagtaaagcatacacaatgatgatttcgtttcttgcatgcttgtatgactgcattagactgatttgtttcatttgcgtcacagttacttatatatatactctttgatttgtgatacaggaattgctgcctaggaagattactgtgtggaagttaaaggacataaaatgcttaatatagatggaaagtacagcttgagtcaaagtcgtggatgcggattacttgtattctctgtgaagaaatacttcaggctagaggcgcattcacttgagctaattcgatacctgctatagaacttctcccaatcaacgtttacaaagcgaagggacgtcaatgtaaggtttgaacgtagattttctagtatagatttttcattttcttcggtttttttcttgtccctgcatatggttgagatgtaaaattggatagcggaatatacttaaagataattgtatcaatgcatatctgatctgatgaaacaatgagacgtaaaatgcagattgttctttcctcattagattcttttcttctttatttttattttcatactgtaatatgcttcagcaaactttgctggctgttgtcgaactttgttatcttatcccattctggaatctgccattttcaatttctataaaattttcagcttatttagtgtagtaaacttgtaaaaattgctttgctatgctcctgaattctacataatgaatatacagtcaaaacctctctataacaacttcgtttgttccgaatatttttggttgttatagccaggggcagagcgagcctcctaggtgtgggttcggccgaactcagtcacttttgcttaaacgtgtatttttttttaagatatccattaaatatgtataaatattcaattgcgaacctaataacaaagacgagctataggttccatggcaaattcagaaccctaaacttcaaattttggcttcgctgtggttatagtgaagtgttgttatagagaatatatataaataacatgaaaattggttccgaaaaagcttgagttttatagagaaatgttgttatatagggatgttgttatagagaggtctgactgtaatggtttgttacgcattaaactttgcataagttatatggaaattttatgtattactttataggatagaatgtggaatacaaatacaaatacatgtattttaacatgtgttgtatgtttattcaccgtataccacttcgtattttatgtataataatactaaattattattattcaatgtatgacaatcttgcattataatccttatataactaacgacttcaagtttcataatagtttagcaaagagtatcctcaaatttcataatttttgactgtcaaaataaatttaaataaattaatatggcattgattagaaagagataagcctgggtgatagagctatccgaatttattggtggacggtagtaagtatctggtgaaagagtcaaggtgcgagcaaactaagtatacagaggtgccagcataatataccggagttccaatataatataccggtctagcataatatactggaagttcgtacacaggtgctccaatctctaatatattatgcaggaactttccaatctccaatatattatgcaggaactttccgggtgttgaagttccagtataatatgctggaaattcatacacagacgcaccaatctctagtatattatgctgaaactttccgtggtcagcaaaataatagctatttttcaataactttacaaatgctggctatttttcaattaccaatgcaaaaattagctagcccgtgctattttcacttggtaacgaggactaaaaatttgagttagtcgagtcaatatgtatcgaccttttatttttcaaatttcaaccaatcgagttaatatatttcggataccggatgattaaataaaaaaaataatgtcacaccccatgaaaatatgtggataaagggtggggcagaagaaatatgaaatttggtcagcggtccatggctgactggaccaccaccaaattataggcaaatagacagtacataatggacaacttgtgattgtgtatttgccatgtttttctttcctttttatgctttttttttgtcaattttgtaatattaaagtttaaaaattccccaaatgagtggccatatatatataatatatattcttatccttattccgtggctcgatttataccttagtttttttttttattttctcttttcctttttcaattatttatttgtagtcaaataaaaaagtgcataaaagtaattttttttaatatgtttaaatcatgaaaggatatattgaaatttagtcaagaaaattttgattttatttcagagaagtgatgagatttagtttatgaggatcaaaatgactaacttttacatttatgttggagaacaattcatctattattgagaatataatcagaagttatgaaaagaattatgaactcttagtgactatgtatctccatttaaattcgtttcgagccaatattacgataaagagcagccgcgttcatgcagaattcggggaaggcaacaccaaaatggtgtgatatgaacagtttactctaaaacaagtgttagtgattacttctatggctcgaacccctgatatacatatatcgcacggaggcaactttattgttgctccagaactccctttctctcaattttgccattacaccatagtcaggaatcctcactgattatgtatctccattaaaattcatcttgagccaatattacgataaatagcagctcagtgcataagatatttgcgttcacgcagagtccaaagaaaggacgcactccaaaggtgtgttgtagacagtctacccttatgcaagcgttgcttctacatgtcacacagagacaactttaccgttgctccaagactccctttctctcgagccgacattacaccaaataaaaactttctaagcaattgttatatattttaaatattgtttctaataaacaagtcaatatttttatctctcaaataatataacatgctaacattttgcttaggaaaaaaaaaagaaaatggatgaatattatagggcattaaatataattcattctaaggacctaaaatcataatgaatgatgtcaaattaaagaatattataggaccataaggtggggttgccaaaatcaaataattgacaattgacaattgacagggaaattgatgaatgcttgacatatattgcttcatttggcacttcctttgctatgaaattaataatacataatttttagattaacaagacattaaaattcaggagaaattatatattccaaaattttctttaaaacatgattaaagttgcaatcaatggttgtaaatttagcctaaactgaggttaaattataaggaatttttacaccatcggatcacctttatttattatagtaggtaatcagtctgattttcaaccatataagggagcttagtgtaaatatcctataattgacctgctagtataaaaattacttacgctaacggtgtatataagttaaactcttacggggttgtttggtttgaatacggcttttttgggataagttatacttggattagttatactgatattgttttttatccactgtttggtatgtcgtattaaaaattacaattgcataatttctaagaagaagatataagttatcccggcactaattacccaccctttaggagtcgtttggtacgaggtataagaaggtatagtgctggtataaaatttaatatcaccttaatactttgtttggttagcaaaccatgtataagttatcccaggactaaaattaacaccgggataacttataccttatagagggtagggtaattagcaccgtataacgtatacattcttcttacaaattatgcaatgatcatatttaatacaacataccaaacaatggataaaaaataatctcagcataactcatacaagcatatcttatcctggcataagccgtatcaaaccaaacgacccctaaaaggtataagttatcccgatactaattttagtcccgggataacttacacaagatttgctaaccaaacaaagtattaaggtgatattaaatttttataccagcactataccttcttatacctcataccagacgaccccgtacattctctcattacataagtttggcacatctaattagaaataggcatacatttgaaagcacatacagaagagaagaagctgtaccagtgcattatacaaaagaagtgacagatcaaaaaaaggttctttctcccctttgaataatttacatttttctaatggaattttgttttcccacagcaacaaaatgagacctacttctttgttttcctccataatctttcaaaagcaacaatagaaattgaattacaacagggtagaagagatgttgacaagaaacatcatcccaaattatgatgaacaacaccagcctttcgtcgcctgtccatttgcttcttggttttcatcagcctgcaaaaccacagtttttccatttgccaatcgcccagaatcctttttttggagttcttgcgattgaatgaccttccggctcaaaatattatagatctctttaacaactgtttgaaaagctacggctacattcgaggaatccaaagctgatgtttctataaagaataaaccttgtgcctccgctaaggatttgccttctgctgttgtaacctcccgtgcatctttgagatcggacttattgccaacgagtattgtaaccacgttcatgtcagaatgagctgtccatacaagtcaagatctttgctagtcaatcaaggtaggagctaagcactagaatagaaatgcacaacatatcaaatggaaattaggatgaataatctattaaggtaaataaaacagcctctctactcctccagagtatgggtaaagctgcctctcttttgaagggacaagtacaacaaaaagactagagtaaacacttggaaatataatcttaaccattttaagattaatcattcatgagcaaaacacaacatgagctagcgacagatattccatttatcgagctgtaatgcaacattagtaacttgtactctttatcaaatcttaactgcagagtgcgcaagtcaaataatttataaaccaaaaggagcaaataaaattgacatataacttactctgaagttcattaagccatcgactgatattatcaaaagtttggcgtctactaatatcataaaccagaagagctccaactgcgcctctgtaatatgcagaagttactgctctaaaccgttcttgacctgctgtatcccatatctgtgctttgacctccttgccatttatgtccagcttttgggtctggaactctactcctattgtcgattttgagtttggataaaattcatctcgagcaaatctagcaagcaaatttgacttcccaacagccgaatcaccaatcaaaacaatcttgaaaaggtaatcctccgtttgtgcttcctcggaatgaaacgccatcttctttgagtaaaatggcagctagaacaccatagttacttataaacaccaaaagtaataaatttaaaagcacaaacaggcagaaggccgtcaggaaaacttgtaagggaatgcaggaatatgtaagacgagacttcagcttaggaacgggttaaagagaagaaaggtatctcaatatagtagttgtatatgaaggtgaagattaacaaggtaatttaaaataagaactttctattaaccctgtactacaacttcttccagccacttcactgctggataactctttcctattttattcagtcctcctaaaagagacagcttttagatacctgcataaaaagaaaaagacagaaacttaaaacttcagcaaagaatccagtctaaactttgctttcccataaaaacaatgtggcattcttctagaagattcttcaataggatacagtctaatacaataggtaatggaagaaaattatacatgaccaatcagctgttgctcgtctgatgccccatccttgccacctccgacttcccctgcttcttgttgcagacgttttaagcgtaaacctagaagaaaaacgaaatgacgtactggtagaagacttaatctaaaattgagcttgcagaacattcacttccggttggtgacaagtgacatgatataagaaagccaaaattgctatctccacaaaattcaactaattcaatttaagtgaccaagtcacaccaatgttacaccacaaaatattactccctagtaatgcaaaaggtcaactaatcataacactgctgcattagttttttcttcttttctcctttttagcttcttcgggataagggggtgagcgaggagggaaaagggtgggatgagagagagagagagagagcaaataattcccagggaagtcatatgtgtagattgcaaataatgaccataggactagtgatgctcaaaaagtttgctaacacataggaccaaatgacaccagaaaagcatctggaatgcccaaaagttcaagggaacaaaatactcaaatctcactgcatatttttaaaattgatatgttcctaaaaattgaccagtggaaatatccaccagtacagatttaagcccaacaaagtatttagtgatgacaggtgtaccttctaaaaacggcttaacctcatgtacacgcttctctcgctagttctgcaagatgtctaacatgagatataattaaaaaacattaaagcacagtatcacattctgttattattttttgacaagtattgtacagtaatattgtagtttgttttttaatcctcacaccggaaaagatttgagtttaagttccaatttttcaatggaaaaagttgaccatctttggtcatgcataaaactgcctaaagggcaacctggtgcactaagctcccactatgcgcggggtccggggaagggtcggaccacaaggtctatcgtacgcagccttaccctgcatgcataaaactgcctgctaatggaaaaactgaagcttttacttttgcaaaacatcctcaatacattttcaaaaaaagcagcatgaaaacgagaaaacaaccacttgtgggccacttctcatcttccccttaggcaaaccgaaagacaattaggagttttatctcccagaagaaagtgccttggtattaaaacctagtatctaaatgttgattgcccttatttaaattttatgatagataaagctcaatcaaatcaataaaatatgcaaatacaaccttcagtaggtagtactagtccacaatatggctagcagatagtatcaaaatggtttatgcatccttatttacttcacttaataactaagttgctccgacatggcagtttagggccgcacccgtgtcaacacaacactagtatgggtgtgggtatgagatcgtaccggatatggccaaacaactttgggtactttaactacaacggacggaaaaattcgaaacgagatacaatttgattcctgaaatcagaaccaaaactagggtaaatttgaagaaaataacgtactttatctagcaagtcaatcctttacttatctacaacttgagaagaaaaaataaatccacactttataaactatacataagtattccataaaatttctcataatttagagatttttattttttttattttttaaaattatttttagccggatctccgcacccgtatccttactaggatccatatcccaaatcttagaatttacatctcgaaggatccaacttctagatccacacccgtgtcggacacccccaaccctgtccgagcaacttagcttaataaaggtaatagatttgagggacatgctggtgacctgatactcaaaaggcaaaaataaatttaatggagagaagaaaattccaaacacagtgttcaattagagacactaaattcaatcaagttaaatgcttgtatcacagtcaactacatgagatggtcacaaagacctcttttttatccaggccagcttccccaacactctgactaatccactagtaccgagtaattatgtccaccaaagcttcgactagcatctagtatctttgccgggatttgaacctagatcacctatggtctattctaacttcattaaccgctagactataccatgaggtgctagtcaaaaagatcaaatattaacatgtaatatgatttcctatatgggacccacaaagtaaatcagttcaataataggtgcacttgcatagacattcacaccaaagttaatgaggtcagctaaacaaagactttgaacaagaagacatttaaaaagtcaccatatccctccctccggtccaaaataagtgatttttaattagtaatgaaattgaccatattaacctttactatctcttcacataaacactcctaacacatactccaacactacttactctaacgccaatgaaggaaaaaatattcattcttgaaatatggaaaaatcacttattttggacaacaaaaaaaaaaggccaaaaaatcacttattttggacggcgggagtagtaaacatatcctaactgatccaactgaacattatttgttgtctcatcaatgccattgtaaagactcaacattttacatgacaccacaggaaatatcaaaagtaaacaggaattctgacataccaaaaacagtatttagtactaacattatttaagtgaaacaaatatatgcaccatgacattatggtttggcattttacccattaaagatagaaaaagacacatgctacactaagagctcgtttggacataaaactttttttcctttttcccaaaaaaattttactttttcaaaatgagcggttgtttatacaatttcaattttcaattgaacatgcattttggaaattttcaaaaatttgaaaaaccgcaagaagctgtttttcaaacttttcactaaatcactcacaaaacttcaaaaacaacccaaactgaaattcatgtccaaacacaactctaaatttcaaatactattttcactggaaaaattttttcaccattttttgaattttataattcttatctccaaagcctactaaaacttttaactctttttttttaataactgtggtgttcgaccagcttgcgtgcacctcgattcaaagtgcaattaactaccccattctcaagaatactcctaaatcaaccccttatttttatttctatgcaacacaaatctaccaagagaaagaagtttcaatattttcatcaagaaaatactagagatattataacaaacttacaaatgacaaaactttaaagtaaaccagcatcaggaaacaactaaaaaatgtagcattgataaaaaaagaaaaaattttgagacatacccacttctttatatgatgaaaggatctttcccttttaacaatctctcaagatgtgatcaaatcagaaccgttagatcaatggaacaaaacgggtataaaatagtaaatttggatgaaatgtagtgaagaaacacagggatcaaaatattgaatgaaaatgttaatgagatttggagagattggagggtgggtttgaagatccagaaaagctagaagtggggaagagagaagaagaagaagaagcagagagagagagagaagggagcaaagggaaagaaagccagattttacaactattgcaattggagtagattgtcacattaaatgggctttaaaatctggatcttcttctaatggatcgcagttcttttttggcccaatttaaatagaagaattagcagcccatattaacgagaagaattaacccaaatagccgttcaccctacaacttaaaattaaaaaaggcaatgaatgtatattatatacataatttatgcctagaaaaagcaaacaattaatatggccggttatttgtataaaaatccacatttttttaagttaggcgcacattttttaaaaagcatatgaataactttatgagaaaactatcctctatagcccctcaaaattttaattagaccatatgttttttcactcacacgaaatggcttttcggcccaaatatattacatataatagtccgaaatatctattttgtatttttttttgtatagtgatagtctcttttgtatattttttgtatggtgacagtctattttgtacagtgacagtctattttgtacaatgacagtctatttagtattccctctgttctaatttatgtgaacctatttcctttttggtcatttccaaaaagaatgacccttttcaaaatttggaaacaatttagcttaaacttacaattctaaccttaaggagaagcttttacaaccacacaaatactctggcccctttttgacttgtttgaaccacaaatttcaaaagtcttcattttcttcttaaactttatgcccagtcagacatgttcacataaattgaaatggagggagtatatattttgtatagtgacagtcgattttgtatattttatataatgacagtctagtatatataaactgtatagtggcagtctatttagtatatttttgtatagtgacagtctattttgtatatattttgtatgtggcagtctattgtatataaattctatagtgacagtctattttagtatattttttgtctagtgacagtctatttagtatatacattgcataaaatttgtatatagagtgtatcgtgcatcatgcaatgtatccataatatatcattaatgtattccgaaccttttgtgtatccctttttgcataagtgcaattttactgacttaatcttaatctcgaaaggagtattgagggatgaaaaagcaacaaaaatctgttgataccattagcatatggataggacactcctctaacccatcacccacgtcttttgaacaacgataacgaaaaggaaatggaagggaagaaacaacccaactattgtaaattttgaaacgctgtgtttggcaagagcaaaaccaacttcttcaaagaaaatgaaggtggaaaaccccctcttagatggggtaaggtctgtgtatactctaccctctccagaccccactgataagattttactgagttgttgttgttgttgtagttgttgttgttgtgtttggcaagagcaaaaccaacttctacaaagaaaatgaagatggaaaaccgcctcttggatagggggtaaggtcttcgtgtactctaccctctccagaccccactggtgagattttactgagttgttgttgttgttgtgtttcgcaagagcaaaaccaacttctgcaaagaaaatgaagatggaaaaccccctcttggaagggtaaggtcttcgtgtactctaccctctccagaccccactggtgagattttactgagttgttgttgttgttgtgtttcgcaagagcaaaaccaacttctgcaaagaaaatgaagatggaaaaccccctcttggataggggtaaggtcttcgtgtactctaccctctccagacccactggtgagattttactgagttgttattgttgttgttgttgtagttgttattgtgtttcgcaagagcaaaaccaacttcttcaaagaaaaatgaagatggaaaaccccctttggatagggataaggtatgcatatactctaccctctccagaccccactgtgggggattttactgatttgttgttgttgttatagttgttgttgtgttttgcaagagcaaaaccaactttttcaaagaaaatgaagatgaaaaagggaagttttcatagtattctaacatgaaaaaatctcaactctttccttagatattcacaaatcaatcgctagttttaaatcttctatgctctttcccacaattaattactcaataggccaaaaattaacactagagcaagaggaaaacttgaagaagctaaaatctgagattaaaaagagatgagaagttaaattaatcaaattaacaccaaaacgtttctttgcttgttgaggtggaagcttcagaattggaaaccataattgatgagttgaaacagttgatgatggcggtgattgaaacggcggagcatctatgaggatcggcagtatgtctgtctttgcagccatggcgtggtcgcctctcttctcgcgatctgcctgtgcagatctgagcttcttagttaagtatttttggactagcctctataattacttttgagctataaaatgaatattataattcggactaccgggtattaaaagtttggcccgaatgactataaatgaattttgctccaattttatttagccaaatcctaaattttccttttctctgcttatgataaacaaattcctaaattatagggatgaaccttttttaaatcactttttatattttgatcctattatgaaatattttggaaaacaatctcgcgcctagattttaaaaggagctaggtaattttgaagcatgtcggtagaattttaaagcacacaacagttatagtgatcgtcaatatttagtatttttcgacaatacttttatgagaaaagttgctttatctattccctccatatattattaaattgcaatagctccaacaaagatcgatacaagaattgattatgtaatttattatgtctttcattttattttatgtggcagtatttgattaggcgcaaagttaattaaaaaataatttttaaaatttatgactttaacatgttacgatatttttggtgctataatagcataaaattaatagtgaaatacgaagttttaaattaaattactttaaataaaaagtgattttttttataaactagactgatacaatgacaaagagtggacaaaaaatgttatatatctaatgtgtggctaaagttacttttgaaaacgttaaaaaaaaataaaagacaagttagcctactataatcatatagtgagattaaaattcatatagatatgtaggcgactggaaatatttttataggaaatataatatcttaaagtatgactaattgttttattccaacttaagtgtgattttattctaatcatcaaatggaataaagcgaaagcgttttgaggacagtttaagtcacttgagctcataaaatattctgcaatttctggaaaagaaaagaaaaaaaaaagcaaaaaactcagtgtaatctcacatatttttaccttttttacaacgctctatagaaaaaattacaccatttggttttatttctttttacataaatttgctttaaaatctcactttacaagaacaacaacaacaacaataaattcagtgtaatctcatattaaaaactggagagggtggtgtgtatgcagacctaatcctacctcgtagagatagaaaagttattttcaatagaccctcgtcttaacgaacataagcaataaaaaaactagcgaggagccatggaaaaagaaaaatagataacagaagatagtaagatgaccaaaatgaaagtaacatcgggcaataatagaaacctaagactaaaaagacatatgagagtatgtaataatgctactcgtaagaacaagaaaccacttggccacctaattttttaccctaattctcagcttccatgtttttctatcaatgggtcatgtcctcagctgagcattaccatatcttgcctaatcacttcaccttaatacttctcggcgtacatctacctctccttaagccctccatggccaacctcatcacacctgctcgttgatgcatcgaaatctctcctcttcacgtatctaaactatctaaatttagcttcccgcatcttgccctccacgcatcctcgaaatacctcactatataaaactatttttgtggcagttagtttgtaaatggcagtactgcaactagatctgttgccactgctttaaagtttgaataaaatggcactcagaaagaagcagcaggaaaacacacttccccatttaagtttctttgtaacttttttctctcgatcaaaggcggatttaaaatttaaagtttatgggtttctactacaattttaaattaatataaaatactaactggtttcatggttaaatatttataaatatttagagaatttcttaataaaaatacgttgtctatacaaaagttaattaaaatttcaccaaatgttaaagtcgggctgttggcaaactaatgtgtcttcaaaattggccatgtctttgttgctgccataaaattaatgacgataacattttaacttttctctgttacttatctttgatcaactttttcttgtaacgagtaaatattcgagggttagtggctctttttttaaaaacagaattgggactcgtccggggctcgttcagggacggagcactcgtaaaacgtctttggacttatgtgtggacttagttccgtgagacttacgcctcggctatcgagacttacgccccggacacgcccaacgcccacgtactggctcgctaatgaaactttatgcaattgtgtgtaactaaccttgtaaatcctaaattttcttaataaatcgttgactattcaaaattacttttttcttaatcataaatcattaagttgagatattttattcataattaaaataaaaattattgcacgttatccactaagactgctatatatagttaatttaaataaatctttcatttaaaaatatttatttattaacttttgttatgtctttatataatagtccataatttttttataattattttctaaatattattttttcacgtttacgaatacaatacttattaatttaatagctcagtattagctagtaactatttacaaataattagttatcatggtattgtatggtgaattatgtgtcactttattaacttgttgaaacttaaaaataaatgatgctagagaatcatattattaaattgtgaattatgttttatataaatttctttaaatagaaagcatattaaataagaagtattttaagaaaaatatcaaattataatatcgaaattctttcaagattcattactccttaagagatacatataagatttcgtatcgaatacattacttttatgtttgagttgtaagacgttgagctaatttgcatattatgatatatgtcatacttttcgtattattcatagttgaattatttataaatattttaaatagattatttgttataattttgtgattttaatgtaatttttataattatttttttatttatattattttaaaattcttgaaattagtaaaatttaatgatccatgggacttacccccctctctcagggcttacgcctcgcctcgtcagaagtgaacgctcgcctcacgcccccgccttttaaaacattagttagtgtgcataatgatagatattgttcatttgaatctagctagtagttacaatgtgaagtataaatttgtatgaaagatcattaaaattgcaataaatagtagatatgaactcataagtttaaaaacataatgagttcaatgcgaaaaccttaaaaattgaacctatatagcttaaattttgaattcgcctctagtgacaaatagttcgaaacttggtgaataatgagctcgcacttttactcttctacactaaggatcgcgatttctttctttttgctcatctttgatcaacttcaatttttcttgttttctaataatctgtaacttttataattagtgtgaaattgtttaaatgttattcggaacaaccaattaagtagcccctagtggtcggaaaaaaaccgactgaagtcgtatcggaaaatatgtaaattgatcgtaaaagtcaaagaaaaaatttcacacaaagatatcgatcactatcggtcggaaaaatggtcccacaacaaagacgtctgacacatataaaaattcgaccgacatcagtaggaaattggtcaatcattgaccaagacctgatcatatttgcatattatgttctaaaataagttttaattaaaaagattcaagtataacgaccgaaataagtcgaaatttgaatttatttttgcccgcccagggtcaattggttttttccataacaaaaattatatatatctataatttaccgactgatttcagtcggtattattattagattatttaatttttacaatatcaacatatatttcaaaatactctctctctctctctctctctctctttctctctctctctctcatcaacacacacacacgcagagagtcttgaatactttactctcaatcaccttattagtactttgcttggatactcatcagatcaattgaaaattcaattatattcgactaaaaacttaatataacatatttaaaaataaagtgtgtagttctataagatgtagtgctatattaatgcttacattttagcaacaacaacatatgtataattatattaatagcgttgagccagatgtctccccttttgtgcacgcttcagattcatcggaggaagatggtccagaagaagtgcagtatgatcgttatcataggattatcatcaagtatgagggcaagggtaagatttatttattacttctttgtttttgctgaatgataataactagtgttatttatttaatgtaactgctatgttgcagggtcgtacctaatcatagggctacaaagataatcgctgaagcacttggctggttgtatgatgcaccctatgcgacttggagtgacttttcaccagagctcgtggagcaattttcaaccaatttaaggtttaatgcgattcttatctatttaagcactatattatcaatatttccatataacgttacacatttcatttgcagactaagtgtgtcgggaggatcggcataacagtgtcattctttcaaattttgtgttcaaatgccgtaagagactatctgattccttctattgtgctcgggagaagagcaagaagccttcatgggttctacgacacatatggaggatctgctgaggcaattgaccactgagaagttcgagaagaagagtgaacagggaaagaaggcttgagcatctgagaagagtgactgtgcaaggagcatggagactgtgatgagactaccggtaattccttaaaatatttaattctatatatatatcaaatgatatttatatattttaatttagttaacatgttttattataattgtaggaaaaaaatatgggaggaagatgactcgtgatgagttctgcatggagactcacatcgggaagaagaaggcaccgatagatccaattagatgggtcgaggaccggacggagactacatatgtaagtttcataactactataacttgaaattaatatttataatattatatagttaataagtttctatcttttaaataaagggtcgctacaagactattgtgaaggagtacactcagagattgcaagcgaatgagcaaggcgagcgaccaccaatttcagacgaaggcggacagaacatatggttggatgtttttggcggtcctaaaaaggggaatgcatacggccttccagagagttcattttggtgctgcagggctggattgcaaggtatagggacttccgtccgcgaggcaattaataagtcgactgtctcgtctatggataaaaagatcgcaaagctgacaagagcttgaagagacaaaggctagaacaaaagagagataaaaatttgatacccttcaagttcagtgaaaagagggaccaacaatttaatctccttcaaggtcagctggccaatcttcttgctagtggtgctttcccattctcggtctcgtgagccttccccagatgctagtccttctcgtcatgatccttcgaaccagccgacgatgaagcttctagtagtgaagatggaggtgatgtaatacaaaacactcattgaatgatgtttgaacttttaacttgtgaaacatttttgttgggtatgatgttttgttaatatagtttagtggaatggagatgagttttgttaataatatgttttgatagtgatgttgttgtattgttgttattgttgtgttattgattgaatgacagcaatgtaatgctgccgattataggtgattggttgttggctggtggtgcaacaataaaacaactgtattctgccaaaaatatacccagaaagtgagaaaaccgaccgcagtgggtcgaaaatgttcatttgattgcccagatattcaaaatttatcggccgacttcggtcggaattttttattttaaatattaaatattttaacaattctgactggggtcagaatttttaattttacgttttaaatattttaatcatttcgaccgaaatcggttggagttaaacaatttgaaaaaaaattaatgattaaaattctgaccgatgtcgatcgctacttttaaaataattaaactttattttcaaaaatactgaccacttcagttggtataattaatttttgtcagataacttggtcaatgtgcgttgacaaataccaacgatttcgatcggtaatatcaactacggtcgctgccctattgcgaccattatttttccgatgaattgaaaatgatcgataatccggtctgtttttgttcaattccaccgatttcgatcgattatgctgtacgatattttacaaatgttaagtagtgttcagaaatcaaacgcataaattaattacattacaaatagggataagagacaaatgaacattttttacgtttacaaaattattcagttaaagataagaacacaattaattgactagagaatcatttaatttacccggaaattttggatatttttctaaatatcttacttaattaatattgtctgcacagccaaattttactttttaacttcagaaattactacttgtttacgatttgcatcactaaaatctctccaaatcaaataatcacaatttaatatcgtttagatatagattaatcttcaaccttttttggacaatattcaatgatgtaagttgcctataataatattattttcctaaaaaaaattgcatttatacctttatataaagctaaaattattcaatcttcgatacaaatctaataatttaatcaaatatacgaggaggagaagccaaagccaaaggaagtgccattttggtaaagttagattctttttacacttagtctattattttaattaatggttaatttatctaaaataaaattatattgattacgaatttatactcttccaattaaagacattattttaatagtgatatattgttttatatgaactttttgactaatatggattatggatatattgacgttattattcataggtaaaatttgatcacatgtgatatttagtatttacagaagatcatatcgacttatcatcaattaagcgatttaataaagtaagaatatactaattaactataattgaacgagagaaatttatatgtacaaatacatatcatttatttattgatttggtaaatatatcaggcacaaataagcttttctgattacctttgattatctaatacatatggttagcggcttattttcatcgaatttttaaattattaatttgacaaagtaataattaacctgtcatcatagattaaggtacatttatattgtaaaaataattttaacgatgtaaatatgtataactttgggttattattacttttagcccgcgacaaaactatttacacatagttgccagaaaattgtatagaacttgtataatttagcaaaatgacgttgtatagccgctaaaaaaataatagccaaaaatttgtataaaacttatacaatttttgtatattacgtacatgatatgtatattacaaaaatatacaaattttatacattttcagttattattttttagcggctatacggttcatttttgctataactttttattttatacggtataatatatatattatatatatatatatatatatatatatataaacttaaactcaatttataaacaaagtatcaataatgagcatctaataaggttaaaatatacaaaacacaccataattaaaggacaaaagaaatgtcattttcttggactaattttagcatttaacatgtaacatgtctacattaaaggcccgaaaaccataaaaaagaaatgaatagcgtgattgccgattgaaataaatatgagagttgggtcatatgccttttgtcatattcttcatgttgtattttaaaaataaagtatttttttgacggtaacaatcatccacttataaaaaaaattctttagcaaaataaataaaagatttttttttggtattcatgttcgtttctttcttccttcccatagacacgaaaggattatgcagccggctattgtggctcagatcggtgataaagcagctatgtctgctgatactttatgggtcggatactcccaatatacatatttggggtgtaactatttagtaagaaaaaatctaacctcaatcaatttcttgatctaattgtttcaatttaatttagaagattgaacttcttgaaagcatcgcgattgaataacatattcttttccaagatattttgtttcattgtaaagtttagagtattagtttcaccccccaccccccccacccccaccccccaaatccccctccttatatgcaaatatgcatttaaacagaaggccattattgaaatggtatttctagtaaatggaaagaggtgacaattttggcaagtccataaagagaaaattctcttttttcttttccctctgtgcgtaggatgaatccttctttcttaaatgaatatctgcaattttcattgcatgtatttttttaaaaaaaccattcggtatttgaattttactgatccgactaattcaaattcgagtgaaaatagtatgagttagccagtttttggactgtaatatcagtgtttgcaaaatcattgaaagtagccactattttactgcaacacgaaaagttctaacagaatatactagagattggtgcacccgtatatgaacttccaacacattatgctggaactccaattcacggaaatgtccagtataatatactagagattggagcacgtgtatatgaattgttgcggtgtattatactagaatccagtatattatgctagaatatatttcgaattttttcgtttaaatttatctttacgtgaaaaatggttgaaattaaattacttttgaaattgtgactatttttcagttaccgctcgtaaagtgaatgaatttcaaattcggccacctaagacccaattaagaggacattctctgcaagaatttctccatttaaagtcaaaccaatcaactaaaatcatgaatttgcgttatcagctctttaaccattgtatcattgagcgatgacgtggaccccatggcattttcctctcctatgtcactagttcacatcatttacatatttttattcgcacgttttgatttttcacgcccttaagaaataataaataaattatataatttatcgtgatactcatattaatttatgtatattttattagatttgaaaaaaataatttaaaattaatgataaatagtgtaggtataacatgaaaaaaatatttatctttttttgatatgcgtaaagtgacaagtaaaataaaaatctatttttaatataccttcaaagtaaaagttaacagagggagtaataaaaagactaaatcaaacctaaaccaattataagtgttttttttggctttttttttggaccaaaaataagtattttattcatgattttaagaatgaattaattattttttttatagattacccttggagtaaataatgttggagtatatgttaggagtgttaatgtgaaaagatggtaaaagttaatattgtcaatttcattactaattaattttaaaatataaatttcttatttcttatatatatgtaaaaatactaaaaaatcacttattttgaatcggatggagcatagagaaataatcccttattctatatggtaccaattcaaagttttttacataattgatgaacaaattgtgatagttgcaattacaatttactttggtcatcctttgttatttccaatattaattaacactataaacttttttggagtcaccaccatacaaacaatttcctactactaaatgcattaaatttattctcaatccttatcttataagtaatttttttagttttggcttttgtgttgtgaacaattattaagttgcttatcttttttcctatgttttcttcttaaaaataacatccttaaataataatatttttttataaaaattaagtttttttggagtcaatttttatgttatgttataatatatattttttttataataatacttcattatatgtacacgtgtcgcacggtattttatcctttaatttcttttaaaatcgttattataatattagtgataaagaaaaataaaagaatcgccatttcctcctattattatgggaatccgttatcacgggttataatatccttattagccggatttcatgtgtatttttttcttttttaaagacggtgaaaatcaatttatttttcttaaaataatctcaacatttttattgagagtcgctctctgagacgtctaaatagtctcttatttgatcaatggccacgcgacacgtgtataaatattatatattcataaaaaatactatgtattataatacatgattttgattggcaatttgtatcttattaagaaagagctatatccgtttcatattaatagtcgttgttactaaaaatagttgtctcaaattatttgttattttgaaaatttaagacgaaattgattatttttttctttttttacccttagtaataattgttcttgaatattggataacacataaatagaataaatattcaataaagggagattatattttataacataaataaaggtacaatagtccaatttctttgctaattaatatttcttaaaggatgtgtaaaagagaaatacgatatatgatatgagacggagggagtattattttctaatctctatataggataaggattgactaactgtaattaatctagtaactttttgcaatttttatttttgtctaattctacactaattagaatttattactagtccatttgaaattattatagtggtaaaaacaattagtgttaatttattaaaattacaatcctacaaggattttaaactaaaggagaaacatatcacaaaatcctcaactgatttgactcaaatatcttttttatactcttcctttttgacttcggttactacatttatatttatatatttatatatttatatttatatttatatatatatatccattccttcaatttatatctaattattctttcttatcaacgaagttgaaaaacaggtcgtggggtttggactctttgagaaaaagaccactgaagttgagaatttcacttaggtattgattttctgttttcttttatttttcaagtttggttttgcatgaaaattatactgtttttttttctttcttgttttaattctcaatctcaattgtcattgtttttttaatcttataaattttattcttaagtttctacattttttttgttgaattctgcatgatggtataatttattttctttgatctgattttttttatcggcattcttgtttattctctagatattaatattaatattaatgatgtgaaattgtgaatggtcattctatatataaaaaaaattatgtttctatatgggattaatttttgatgtattaagtggatactggattcttgatttgacaatagaatcaatggttgcttttgttataaataataaaacagtgacaatttatgtttctgtatatatagaactggtatttgccttttgtttttgccttgttaagacaatttggcatatgaaactgtctaaatcagtatatccattgtacaaattggttaattttttgtgctaaagttggttccttttttgttccagaatcaattcatctttcctcaatttttagtattaattagcatatcaagaatatcggaagcagtttctctgccctttcagggtaagggtaagactgtgtacatcctaccctccccagaccccacttgttggattatactaggtggttgtaattaaaatatcaagaatctttctttttggtcctagtgctactttttgcaatttgtattaatgaatgtatttgatcctcaagcaacttggatgaaaattgtattggataatgaatgtgatttagattaaaaaggcaagtcctttgttgttggcaggtaatttgctgtgaagatttctcttgtgaattcattttaagcatagcagaaaactagattgataccgggatactatggaaggcggtcctcacaaagctgataagacggagtttacagaatgttggaggacgtcatggaaaacgccttacatcatgcgtctcgccttttctgctggcattggagggttgctgtttggttatgataccggtaaatgacaactgcttttaatatcagcctttgtgattagaccagatggctcgacactatgttgtcgataaaacctttatcgttaaattgcagtgataagatgtaaattaatgttaagttcagtattaatgaagtttctttgttgcttattaattttaaattttggctgtatgtgattttcttgcaaacaaggtgtcatttctggtgcattgctttatattcgggatgatttcaaagccgttgataggcatacttggttgcaagtaagtgatttactctgctttatatatcaattcagtttgatcatatgtgaaaacagaataacatgtttttttcaaaacaatgtaggaaaccatagtaagcatggcggttgcaggagcaatttttggagcaggatttggtggctggtttaatgacaaatacggtcggagaaaatcaattcttttagcagatatcttgttctttattggtgcaatcgttatgtcagttgcgccagcaccgtgggtgataattattggaagagttcttgtcggtttaggagttggaatggcttccatgacatctccactttatatctcagaagcttccccagctcggattagaggagctttagttagcacgaatggtctgttaattacgggtggacagtttctatcttatcttatcaacttagcatttaccagggtaatacatcttgaaacctttttgctttttttttaatccgattggagttgtttatatcattttgaatgttaactgatttttgtgaatacattagaccaaaggaacttggcgatggatgctggggtagctggacttcctgctttgattcaatttatcctaatgctatctctccctgagtcacctcgatggttgtatagagaggtacggcgattgcctgtttaattctctttttagcagaaaatttgaagagtctttcatctggtagattctctcattgccttaattaattgtccgtgtctttgaccttttgtgcagaacaaaaaagacgaagctagggctatattagagaagatatatccggctcatgaagttgaagatgaaatgaaagctttggatttccattgaagcagagaaggctgatactcaattccttggagcgggtattttctcaaaagtcaagagtgcttgagcaacactgttgttcgtcgtggtctctatgctggtattacgtccaagtggcacaacaatttgtggaataaacacggtcatgtattacagtccgacgattgtacaactggctggatttgcttctaacaagacagctttagcctctcgctcataacatctggtctcaatgctgtcggttcattgtgagtatgtgctttgtcgacagattcgggaggaggaggttgatgattgtctccatgtttggtatcatagcatgcctagtagtattgtctgttcttttcatgcaagcttcttcacatgccccgccgattagtgcctttgaatccaatcactttggatcaaattccacatgctcagcatttctaaaagctcccgatgcatcttcctggaactgtatgagttgcttgcagtctcctcagattgtgctttctgctctaatggagacaacaaagtaagttttgttggttttacgtcctcattgacgcatttattaactaattccctttgtattattgtcaaatccttggtatgtatatccaaatcagtaccgcagtatgcatttttagtaacagagaaaccttataccctgaggtgccattcgacattctttgccgaaaaattctactatttcatatagggtgttataatatttttctaactaacagtatgtttctatacaatacaccaaaatatacaaagtaaatgtcaatttgagacatgaagtaaaggtttagaacccatcaatcccaaactcaaaccggcctacaatcaagttgtgacaataggcagacattgcttacactaaatcttgcgtttgccattgtgcgctttagtttttctccttatagcattacttgtcattgttagctttttattctcttttttgcgtatttagtattggtattggcagtaactttctttggttcagtatcatcccggtgcatgcttgtctctaaatgatgatgttagaggtttatgccgatcagaaaagcgtgcatggtacacaaaaggttgtcctagcaagttcgggttctttgcagtgttgcttctcggactgtacatcatatcttactctccgggaatgggaacagcaccttggatcgtcaactctgagatataccccttaagatacagaggcattggtggaggtatagcggccgtttctaattgggtatctaatcttatagtgagcgagtcgttcttgactttaacggaggcaattggttctgctggtacattccttttgtttgctggattctctgcaatcggcttagtcgccatattctttctggtacccgaaacgaaaggctgcaatttgaggaagttgagaagatgcttgagaaaggctataaaccgaagttatttcgcaagaaaactagcgaaaagacagcagatgcaagctaagttcaagtcagtgtgacattttttgctggtaatttgtcccatatttatagattatggcgaaaaataagctctactgcaacatgaaagtgaaggtctctgattgtcaagatactgttttatagtcttttataatgtagatgatcagagagtagaacattttggtttttcaattagacatttcaaatgccaaagtgacattttgtttttatcttctctagatatctttgcttcgcttaatatcttcttgttgttacagtcaaatctctctataacaacctcatttgttctgataataattagttcgagaaaagctcggagaggtcgtactatactatttgttgccattacttattttcttttttgtagccgattgtttattggcgataaataatctctttaccttcttagggtaagagaagtttcttcagccgctttcctttttgggcctgatttgtaagtctcaccctctcatttttagttttatgactctacctattttttagagaaatttttagtaatgactattgtttagtggttattaatttactatagcttccatatacttaattactttccgtaactaccttttagttgttatggtaatgtattcgatgtattcgagctaccgtattcattaataaaatagaaaaaatcggctaaaaaataagacaatcccgctgttagctgttgtattcacatgtattcatgaatacaaaatgacaatctacgtagttataggtctctatggttgtttaataacggaaagttactaatttaacgggattagctcctaatataactcacctaaatcagtttaacacacaacattaacaaaccaattaacaagaagatttattataaacaccaaaaatagagaattcttcagagttttagtccctctttttttttcctgatacagttcgagttttttttcctgacattgttcgagattctgctcgaaattgatacaagtatctacagaaatattttgaaattcgattttctgtatatgaatacatcatgtattatgctggacacaacctgtagtagtaacctattgcctgcatatttcataataaatctagtgcttgaattatgttttatctaacagttgtgttccatgtttcaagtttattttgtattcataatatttaaatttattcataaaacatggtattactgcttacttcgatatatttcattggttgtgttcattgattttgtatttgtattgagagtatttcattttattgttgttttaaatacagatagatacaattaggttgaaaatacagatgaatacagttagattgaatgcataattaattgatgaataacataaaaatgataaaattaacaatatatttaaaaatgttgttgtatgaactcaaatacatctatatacaacattcaaaaatcactgtacaaaataaaaatcagggtatgccttatccaatacatataaatacatctaaatacaagaagagaaaaccattgtacaaactaaaatcaatgtatgccttatcgaatacatataaatatctaaaatacaagaagagaaaaccattgtacaaactaaaaatcaatgtatgcggactcgaatacattaaaacatctacaattagggtcattgcgtatttttattctcctttcggcttcaatggttactgatggacctgcaaatacatgttactcttgagtgatttgcaaatcgaaatatggcccttcaaaattgagtactttactggtattctgcagaaaatataacagtggtgaatatttacaaaaaactgttgaagagaaaaggaagaagctttaaccggacaaaaaccgaaaataacactttccacaactttttggaggaaaaaaagttaaaaatggaaagagacaatggctttaactggccaaaagccaaaaacattaacacttaccataattttttgaagcaaaaaaattgaaaattgaggaagacaatagtggtttctgagaatcgtggtttaacaatgagaaagataatggcgatgtgagagagagatcgtggagagaaaaataagatactatgagttaattttggaatagaataacggtaataaaagagaaaattattaaacaccgtatttaatggcttaactatagtgtatatcataaatacatattttgctataaaaactaaaaggtagctatagacaataatattttaaaaagtttttatttataataattagggtgtaaaagtttgctataggaggtaaaattttctcttttgattacacatgggagatttatttttacacgtaagaaatctatcttttacacataagagatctaatttatagtcaagcaagcctttcacctggctcaacacagaaaaaacatcagttaggcctctctctttgtttcgatgaaaaccttaacgctcgcgtcctactggaaacttttttgactatttaccttcatcaaaaccggaagcaaagaacgaaaactccaaaattagtaaataaaggtgcatggtgttgtggaattagacaataacaccaacatttatgtttattttcaaacaaaatgatagaaaaaattgaaagatatagagggaaaaacatcaagataaatgacaagctgttgtgccagctaatgggattcataaaagggacaatagctacgatttttttttaaccaaacaagggtaatctgtcgtgaggttggtggctgccattatcatattctatataatctctgtacattgcactaaaactagaggtgttaatcgggtcgggctgatcgttaacaatccggtttaatccgagttagcccggttcagcccgataatgtagcaaaaatagcgggctgagatgggttggacaaataacgggctttaaacgtacatattttgaaaaacggtgcaccgaacccgctataaacccgtttcagcccgttaacctgttaatttaattaaaaaactatcaataacattgaaaaagaaaaatataatttaattaaaaaaaatagcccgtacgggttcgagctcgttaagcccgtacgggttcgagctcgttaagcccgaacccgtacgggtcctataaaacccgaaaattcccagcccgccaccagctcgttaacagcccgatccattaccgaacggactgacattttttgtgtccagcccgtcccagcccgcccgttaaacacctataactaaaaccctttctttgtaggacctaccctacaccactttaatccccttttaccacaaaaagtagtattgatatttatcgagtcggatttaagattttaagaggatgagtgtactgtgaagaagtgtatttagaatttatatttgacgggtttaactttagttctcttaccatgaaaccactgtacttttgaaattatatgttcaaaattatattatttttgaaaatttagtaattttcacatatatatctatattttgtgcgaaatcaagaccgttcagagtgaaatttgaactgttaattttacttgtagtggtgcacccaacaatacttgcaccataggagtctttgagcatgggttcacgcgcatatatttaagtaattttaaagaaatattacattattgtacataattttgggagaggagtatgagttcacgtgaacccatatctataaatatggatacgcctttgaatgattaccgtcatgttgatcgaattctccaaaaataaccttagtatcataatcgacagtagctaatataatggtagagctaaaagtattagattttgattagagctaaaagttttagtaaatgctaaattagattttgaacccacggttttaaaaatatacaacaacaatcaaaaaattcagtgtaatctcaaaagtggagtctgggagggtaatatctacaaatcttacccctaccttaggaaggtaaagatgatgttttcagtagacctcggctcaaggaataataaaaataaagcgacaagcaatagcaacaacaaggtaataagatatataacataagcgaatgacacaatatatataaaaagaagactaggataagaaaatacaaaaacataattttaaaagtatagtgaatttatgcttaaaaattttaaaaattgaatccaataaattaaaatcttggatataaatctttaacacaaatatcgcatttttgaaggattcaagcagcatatattataacacaaaggcaatgaaagtgaagagcaaattaatagcaactgtgattacctatgaggataaaatcaatcaattaggaaggcttaatttcaatattacttactcccttttagtatatagtccaccgtccaaaaataaaagactaggtcaatcaattaattttgcatatacagtcaaacatttttatgacggctagtggcgaagccaaaagattcaataagaacgttcaaattttaaagacacactttacgagcgggctatgcaaaggtgttcaacgtctatttttaatcaataacaagtaatattttaccttatacgtagtataatttttcggcgaagggtagtcagctgaccacctttgagccaacataacttcgcctctgaaacagcctcgtctgttccgaatatttttggatgttatcgcgaaatgttgttatatagaacatatatacatcataacatgaaaattggttcaggaaaaaacataacctttatagtgaaatgttgttatatagaaatgctgttataaagaagtttgactgtacttttgttttatttggaccagctggtatcaggtttaatggttcaaatgcacctcagagagttaggagggagaaacctattcgcacctaatatttataccaaactagtgaatttaaaccatgcatctctatatcaatattagcagagaaattatgggttcatgtgccgcataaactatcctgtaaatctggccgtgaacgcctactccttcgacgcgccattgccaaaaggaatggtgcttagaaaagggatatggcaaaatgcaagagatttaacatgtagcgtcatcgtaatacttgttacacacttaaggtggcaaaatggttaaaagaaaacagttatccttccatattatccatcaaaaaatgggttagataataaaccattttaaaacggatcgaatatggataaagaaccatattatccacttagaaaatggttaaccaaattgataaccaatggataactaatgtgtttaacttctacatttgtaaagcctcaaattggagttcctcaagtttagaagactaggaattctcataagtgatcatatttaagaagccatatccatattatccaccaattttatccgtttcaaatatggatcggatcgaataattaattcgtttttaaattactcgttttgacccgctcccgtttaacccctctggttccaccttatgtgaaaggtagcatgaacaaaagaggtccaaacatttttaaaaattgttagatacaattttagatcagagcatgccaaaacttgaaaagaaaaattatttcaaaaggaggaattacagtggaggaccaaaaaccacatgaagggaaaaaaaaatagagttaagattaagttttggagcatccaataaatgtatgaaaagtggtcaaaggttggaggaccaaaatggttggctaaccaactcatatgaacccacctttaattgaccaaaatggttgactaagcaaccttgccagctataattcactaggtgacataggaaatagacaaagatcatcttaaaaaaccttttttttataaccattcccaatttaaaaattgactaatttaaaattgtattgtccattagctcgattaaatgtgaatttatcaagaacttttccattttaagacttattcctagacttactagctcacgaaaatatgaatatcagatggaatttaaaattttatgattgaaaaacaccaaacaacgaggaacggtcatgatatgcagagatgattctagaatttaaactctatgagttcagccttcaagattcttaatattgaacccgctatatttttaaagttatgggttcttagtagatcatatctactcgttgttgcagttttagtagatttttacacataaattatgcaccgcgctaaaagatataggttcagttgaacccgtcggaattacactacatccgtccctgatgatgtgaactactacacataaaaatttaaaaatcagatggaatttcaattttatgaccgtaaaacgaaaaagaaaaaaagaaaaggtacgatcacggcgaaacgataatatagttccttaggttgtatttgatgtgtcagaatccgaatttggggttaagggccggacaaattaattccataacacaccctcttgtggtgtggagaaaactaaagacacagaatttcaataaaatgattgaaagaccggtgggggagttctattaaaactaagtggggaacacaggcatctgatgctctctagttgcatagagaaccacaaactctagtgtgatcatcaaagcttggaaattttgatgttctcataattcatgaaaatatcacataaatggccaaatatgttttgcttcatacactagcatatattcatgttcaaaaaaaaaaaggaaaaaacaacctctagcctactatgctagttgattttcacacactaaaaatcaagaaaattagtaacccttctacaagaacttggacctcacaaacaaaactagaggataataacccaaattcttaccaaaccaaaaagaaaaaacccaaaactaggcaaacaacatcctcctccctctaaatatacctagtcaaaaataaggtcagagtttcttcactagcttctaataatattatttttttagtttttttaattatctgagatcatccattactctcaaatttctaaaacactctgtacaaactcttcaaaccacttcttcctatatacagaacaaaaccactacagtagaaatactagtctaaaacctatactctctgaaaatgttgccgggtgcatgtcggatcctccaaaaaaatgtttggaggatccgacacgggtgcggcatcattttggagagtccgcgcaacatagtctaaaactactatttctctcaaggggtagaacttgatgcttcttgtcttggttctctcaagtatcccagtagagtttctgcctgagaaaaaagaaaaagaccaaacaccattaaattctttctataactagaataggatcaaagtaatacagcttgcatctcttgtactaaaaatgcatatgcagactaaaacatcagtgtcactgaaagcaacacagcagcagtatttattctatacgttactgcaacaagtaccagaaagttcaaatgatcacatcaccaaaataaaatgctcatttgaaaagatagcaacccacaccatacaactgtaatctccaaaacttcactctcatgctttcttcatctctttctattttctcccatacccatctcccaaatctcaaacatacaagttttggctcgcctcgcgtagcgctgtagcgagcactatttataacactgactccacaccatatgattatgattataaattcaaatttgtcatggtaactgataaaaatttaatctttattctaactttaagcccttagttaactactggcacaaattagtttaagttaaaagctctactcatcaaaaatcatagaaactttcaaacaaattgtttcaagaacaagagctcctactgataaatgtcaataatttgaaagaactattggttctttaatattactaattccataaaaattcaatctttaactaaccactactttaacaacttccaagtgctaataattgatcaaagatttttccttttcttttccaacaacttcagtaaacagttctagtggtggatcaaaaactcaaatctcacctgtgcttaactttagcagttccataaaactaattctttaaagatcagtctttaactatacacagctactactgctgctacaaagtcctaataattgaccaagaatttttactctcttttttaagaacttcagtaaacagttcaagagatagatcaaaaggccagcccgatgcactaaagctcccactatatgcggagtcgggagggccggaccacaaaggtctattgtatgcagtcttatcctgcatttctgcaagaggctgtttccccggcttgaccttcgtcacgtggaggcaacttaccggcccttcttgtaccagttcaagagatagatcaaaaaattcaaaaactcaccttgtgcttagctttagcagtaccattttgagacaaggcaacaagaggaggaattccaccttctctaacaagaagccctctgtttctaacactatccacacaaagttgcaaaagtgtcaacactgcaaattcccttcctttatcagaaccatcttcaatagcttcaacaagtgcagcaattccaccttcttcaacaatagccacttttcccatttcaatcccagccaatatactcaacaccaccatagctttttcagctaatccattcccattttcacaaactagccctactaatggcttcactgcacctgcaacaatagccctctctttatttaatttcactgaacaaagcttataaagagtcgttaaagcatcttttttcctctatttgttccatttataagtagtcccactaatggtggaatagcaccacaagcaccaattgaaagcttattttcatcaactaaagctaagcttaaaagcccacaggcagcattctgtttcgacgtgtcagtcccggttttgagcacgtagattaatgacttaattgcccctgatgaagtgattaaggtcttgtttggttcgtgaagtgagagatttaacagtgctgttactgcgtgttcttgcgtccacgggtcggtgcaccgaagaagtgggattaggactggaattgcacccgattcgcctattaaagcccgattatcagcccgattcttcgctaataaccttaatttagctgccgctgatcttttaacggcgactgaaggagaatttaagctgtcgacgcagagtttcaccgtcggttgaagatcctccggcgaaatactctcgattatctccgttgaaaatttctctctttctagaaacccgaagcaaggttccggttcgggctcgtgtttagaattcgggttaccctgatccgaaaccggaacacttgctaaccgctgtaactctccagagatatcactactacaagctgagaaatcactgaaagcttgagaaagttccagaaaatcctcttcggaagttgaggatttattcgcctgagactttctcgaaagctcgccaagatgaatatcaatgacggagtcggtaagattctcggaaatagcaccggagttttcagaaacggagccggaacaattagttgaacggaaagtagttgatgatcggatagttctcatggaccgaccaattgaacggttgaatttagcggcggaagataacggcggtggagtgtagtaataaggccgtgtttggccaaaatgggtagtactagaaacactattaacactatgagaatgtgaatgagactgagattcttcaagtgaaaccatttttttttttttttgagttttgaagaaacgagaaaaaatggaggatttttatagaaggagaagaaaggaaggaggagaaggagtggatttggtctatttggaggctacgatttttgattttgtgctaaagtgacatgccgtgtgttgtgtatacctaatagctcattgtcaaagcccgaggttaatttttagtactaatatataagggagttagataatttccttttaattataattttttttaaaaatatttggaaaattatttttaccataagatgttacgagtatagtttttataatttaaaaattaataaaatcaagtatgtaattcctctaagcaccgattctccaaactttaaaacgaatactcaacacgagttattaaaatctcagaaattcagtataagtaatggagcctcgatacatgtatttgaatcacgatgggtgtacttaaaacctttctcaagtcttagaacctcaatatagatacttggcatctcaacaagcgtaattggattagtatgggcacccgctaccttagtagaggtactcgaaacatattcatgtgcaacacgagatctccattcctaaacgtgctcaacgctggtacttcgatccttagtatgggtacttgaaactttagcattggttcccgggaccctatcgtgcttaacacgagtactcgatatgtagcgtgctcaacacaagtatttgaaggccctatatgcgtacttggaacctttagcaatgatactcaatatccgagcatggctatcgttacctacacctgcttagtacgggttcttagtaccttgttgtgtacttagaacttcaacacgagttctcggatccttagcaatacttagaacctccgcacaagtacacgatagtccaatatgagtattttatacctaccgatgctcaatactgtatgaggtggaattgattgattacaagtggttagatagcacgggatacgtggaaccaagaatagacagaagttgagtcgataaataattattatcaatcacgaagtacataacagatatagggtgaatctcgaaggaagcataatcgatggcaaatattcaaaggcttgacatcgagttacattaaatgagcatcctacagagaatatttgcattcaaaccagccgttatacacacatcaatgatacttttattctcatctatagaagagttttattttaggtattgtctccctagaaataactataaatattgacaactcttgtaacggaaggacatattctacatacaaaaactataacatattgtttcaaattcaatcgaaagcatttatcattgttctaccattgatactactcttgctataggaaagaccgagctcagaatcacgtttgctattttccatttaattttaatcgctaattttattattattttatttttttttatttttgaatcaaatcgattcgcatctctataaatcaaattacaaatttaattatatttttaccgataaacaacctaaataccatatattccgacacaactattcgataccgactcaaatcgaatcacgaacactccggtttgaaacttcagcatgaaactaaaagagaacccacgtggaaggtaggtgagatagagaaaaagtatcaaaggcctgtgaaattagcaagttgctttttgcacagtacgtgtttgcttttttttgctttgaaaggacgtcggtgaagggaaatgaggtgacgtcgtttcatcttttttaactctattagtcgctttttagttgtactttcattttccctggaacagttaattccatcaatttttcaaatgtacctccctacaacagagacatgaataatacggaatacgtatttataaaacaaatttattaaaaaaaaataatacgtatggtatacacttttgaaacagtaaaataataccgtaatttagaactttagctttaatctttaaggtcgtttggttggaaacaagatatttcggagttagttattctaccctctcgtagggtgaacatatttcggccggaaccgaataaatcgaccgaacaaaaaaaaattttatttcggttttggttattcggtttgttcggtcggtttcggtttaaaattttaaaatttcagttttttggttcggttttcggttattaagtaatttagttcgattaaccgaaaaaccaaattattagtatataggttctttaagttatatataggctaagctcataggtaataaattaacaataataggtccaatctatcaagactcaacccaattaagtaagtccatcaactttccaatcttaaaagactcgctctataaaaacttccatagcatatatgatagataccggaaggatttcacacagagttgtaatttacacctatgtttgaattttatgaccataatagtgtgcaaagtttagtcttttttttttaataaacataatatttccaacaatgtcgaagttttggaaaaaaaaacaaattcgccgtcctattattacatagaaggatcccgatatgataatgttcaaaccgaaaaccgaaccgaaattagaaaaatcgaactaaaccgaacttatttcagttcggtttcggttactatttttacaaaatcgaaaaccgaataaccgaaccgaatttccttcaaaccgaaccgaccgaacgtccacccataccctctcgtgaggataaaaatcaataactaatctcggaattaactataccatagttttatttcaactagacatgaaataaaatcatctcaaatttaatttcgagattaattagtccttatttctcataccaaacgagccataaagacttatataataaccttcttggcaaggactggcaacaccaaacatggtttatatatattgactataaaaaattatttatacaatcagattatttatataaaacttaataaatttgtatataaatattaattaataatctactaaaagacaacatattaacattgataatatacctaattatttaaaatgccacttgttggggccactggcaataggtcgacgactgtgagagttgatttttataattaattattttgattgacaaaatttcaagttcttcgcaaatttacttttggggaatttcttcatgatgcattattgaaatattaatttatttttttactttcaaaagacaagttaaatttacgggtaaatcaatttcttagcgcaattatactttaacccagtaaaagtattttgctttatttttctccttaattagttttgtatctttgctgcgtataaaggtattaaatatatatttattctttttcacaataaaatgtaaaaagatgtttaatttaaattaaaaacccactaagaaaagctctaagctagaataaatgagcaactaattctagtaaatccaaagtttaattgtataagtatacagttaaaattctctataactgtcttatttattatgaatatttttggatgttatagttaagtattattatcgagaacatttattataacgtaacatgaaaattagttccgcaaaaatttaacttttatagtgaaatattttatagaggggtgctgttatagagaggcttgttccgaatatttatggatgttataacgaattattgttatagaaaacagatattataacataacatgaaaattggttccacaaaaaattgacttttatattgaagtattgttatatggaggtgctgttatagagagttctaaccgtcatgggcgaagccacatggtcataatgatgatcaattgaccaccattcgtcgaaaaattatgccgtgtatgtgagtaaaatattatgttttagaaatatataatacatattgaacactctttatcgaaatttcttttcatttcttaataatttgagtacgctagaaaaaatttctagcttcgccgcagctgataataaatatatatttcataacaaatgaaagtgattatccttttttagaaagacattatcatcatatgttgaaggcggacacgtggataattgagtagagagataacaaagttaaaggatgacaaatgagagaagagtaaattggggtttaatgctaagcttatgctttaatagtatataatatatattttgattgttatttaaatttattgtatcatataattatatcattaaatttattattgtctaacatcgaaaagtgctaccttaatatccaacatggatagttgtgttgttaccttttttttcgtttcttatcttatccttctctattattaaattaataatcttgttttattctaatttctacctttgtacataaataatttagttttgtaaccttagtttttataatgttataagtttatttttatttactggtgcgtgatatcatgaaacgacgataggataatataatacaatatatattccttccgtttctgtttatattaatctatttcctttttggtccattttaaaaagaatgacctctttctaaatttggaaacaatttagcttaaacttacaattatacccttaataagaaacttttataactacacaaatactctaggccccttttaacttgtttaggaccgcaaattctaaaaattttcattttttcttaaattccatgtccaatcaaatatgttcgtataaattaaaacagtgaaagtcaatataatatattatgaaaccacgtgtaaccaacactcaaactaactgtaatgatttttattttatcaagttatgaataagttataggttccattttgaccttcttcctcctggacggccaatttggctcgatattcaagatgtacaaacgagtatagtactccatgcaggtgagagtgtactgtactcgtagttttcagaaatttgcttcattctgtacacgtggttgcaggctggatcctgcatggattgttgtacctttttatatatacaaaataagtaaattaatgtaaatttactttaagacttaataacagtaagaaaatacttagggatcgtttggtacgaggtataagaaggtataatgttagtactataatttaatagtatttaatacttcatttatttagcaaatcagatataaattattctagaattaaagttaacaccaggataatttatacattatagagagtggaataattagcaccgctataacttatgcattcttataaaaattatacaattgtcatatttacaacataccaaacaatgaataaaaaacaatctcagcataactaatccaggcatatataatttatcccagcataatttacaccgatataacttctcctgagtagggggtcgtttgatatgaggtattaaaaggtatagtgttggtataaaatttaatatcactttaatactttatttgggtaccaaacctggtataagttattccgggattaaaatttgtaccgatataacttataccttcttcttagaaattatacgattgtcatttttattataaacataccaaacaatagataaaaaataatatcagaataattaatcccaaaataactaatcccaataacttatctcggcataaaccgtatttagacgaaacgatcccttaaggagtttattgtgtacttcgtcgtttgaaacttttaatcgaacgtacagtagtatttatttattgtcagttgtcacagaaactttagaaatattctccatcttaaatataacttagccagcagataaaaaatagtagtataaattttttataaatatataatgatgaaaaatatacaattaaagaaaaaaatcatagtttagaacttaaaataaattcaaaatttacaatattttaaaaattatacaaaagtaaattatgtgacaccatgtaaaagatatgtcaatatttacgaatgttacaaaataggaaagaaaatacttctgacattttaatttatgtaattctgtttgaccgtgtatattatttaagaaaataaataatttaaaacacgcacggttattttcgtaaatagtattaaattatgtaactaaaaacaacataagtaatttaaatttaaactattcttaaagatatagaatatcatccaattctatatataacgttcttcttacttgattcttttggccaacttagtcaaagaacaaaacgtcattatatatttatattgtgtcaatataaaactcttgcattattaaaataataaacttattaagaattttgtccccagcacttaaaatcattggaagataatgtaaagcatgaatatgtccaaagatttttaattatataataagtaattagataccttttaaacattctaggaacttttactagaattttttggcgtataatggaagaaaaatactctactttaatatattataattaaacgaaggatactgccaatatttggacgcaattgcttctatttttatttatttatttatttattttttgtgctttgttctgttcaaatgcaacatcgctgagttgtttaccaacttaatcacaaattaattaatattactaattaaaaaaaagattatattgtccccattataatatcccattttaatatacactgtcctacaaagaataatccattaagtaggcatttggatatacatttcaattttttttttggaatttgaaatttcactaaaattttaattgaaggtaaagttgtgtttggttataatatttgcaacatatttgggtgtccttttcttcaaaatataaaacaagatttatatcccgcaacttgtaaaaattatcaaaccaccccaatttaattatcctctttgaaataaacaataaaatagctattgtttaactcatattctgctttactgcgacacacagaagatacaaaatcagtatcacattttttaattctactgatatacaaagaatgaatttaagccaaaaataacatgaatatgatcgagttattctttaataactgctgggatcattttatcaattttaaaagtatggggtaaaatttataaaactaaaaactagcaaattcccattttcaattgaaaaactagtgagaaccagtttttcaaatttgaaaatggatttttaagtgaagttgaaaattttggtaagaatgatataaccaaacattgttttgaaaaaaaggaataattttgtatgtccaaacgggcagtttgacacgtcagatacattaattgtgtgtactttatctaatttaattcaaaacgataattagatggccacttcactaaggtactatgggatcactaaggccgattttcgtccatgttcatcgagtgagtcttgtgctcaagcttccttcgatcggcgcgtttatcaaaagaagattcatgatttcttgttaagcttaactttcaattagggtcgaatttaatatttgataaaacctaagtaaatttctccccatatatacttatattttgcgtcaaaaaaccgcctaattcatttaaactcagtaaatatagttgtatttgtgtatgaacagaattcatagacgaaaccaagatttgaaccttatgtttcgaaattttagtatattcttaagaaattatgttttaaattaataatatatataattaatagatgtcttacaaaaaatagagagttaggctgaaactattcgattcggtcaaacccacaaccgaaaaactagttccgcccatgagtatgacggttaggaaaatcctagtgattagtgaaatgaaccgtgattattacttatgcttagtggagtgaattaagcgagtaaattataattctctactacataactcaatttcgatatttctaattgaaaaggcataatagttaaagaccctcttgaacttgacgctttttggcgaatgtataccttaactattcgatttcctagatacctccttcaacttggttttttgaaagttaataactttcaaaaaaattaaattgaagagaatatttaggacctcgaataattaaggtgtatactcgccaagaaataccaaatttaaggggatctttaactatcccgaaattgaataaaaaaggactccattcattctatcgcaatctttatcgacgaataaagcaatttcaccgccaagtaaaatgaataataagaagataaaagccataaaagttagtgccatttaccatgattatgactttcacttggtccacagttaatgaaaacatgcaacgtggtaataataccacctttttatatgtgataatggtaatttagtggaagtgaggatcataattaccatccagctaaaaagatttttatttcttctagttcacaataagtgattttttaacttttttcgtgtgattcaaaataaataatttttttaaattttaagaatgaattaataatttttttctatattacctttgaaataaataatgttggagtatgtgttaggactatttatgtgaagaaataataaaagcatatatatttaattttattgctaattaatattaaaatataaacttcttaatatgtatgaaaaaacctaaaaatcacttattttaaaccagatagagtagtactccctccggtccagaataagtaattttttaattatttttaagaaattcatcttttaacattaattagcaatgaaattgactatattaacctttattatctcttcacataaattcgcctaacacatacttcaacactatttactccaaaggcggtgtagaaaaaaaataattaattcatttttgaaatctcaaaacattacttattttggactacaaaaaaaaaatcaattattatagacaaggaaaaattgtgtttaactctagaaatcaaagattttgactagtacatgtgtgaacacattcacttaattagtgaaataaattagtactttactctatcttaagttagctttttgacaagaaagcaagaagcttttatgtactaacgtctcatttgtttgtacttaattaaggtttaaatttgaataaatccagatcttaacccattaagtatatttaattttttatttttaaaaagtcataaaattgcacgatatgccctatttggtcgccccatttaacctaaatctatatttttaaaattatttaacctataccctaatttttacaacttcaagcgccgccttcctgatacttgtgcaaaacattagcttatttagtgttgaagtttttacaaatgaactaaataacttcaacatcttctactgaagtttttaaaaaagcttttatgacaaaactaatgaaaacttcagttaaaacatgttaagtacaacaaatagagaacaaagttcatcaattacaaacaaattcaggctcgtctattagaatgatgaagtttatgtgattgcctttgctacttcaagcccatatacctgaaatttatgcaaaaaatgaatacgcttgtaattttttcctattttgtgtttaacatcataccatttactacatttttgaaatcttcaaacagattatttgcttagaaatatacaatttatcttcttcatgggtggttcatgggtggctcaaggatgccttcgctttaggccccaaaaatttgagtccccaaaaagtgttgcaaaatgtgataatattttgacttacacaattttgaactttgtagaaaaaggtataaaatccatgtaaaaaaggttttaaaagaacaaagaatatttactttttaacataagaaatattctataacttagaattaaactacttaaatctttgtattagcaaataaagttttttacatcaagatccaaggtaatgcatcgcaaacatatggctaacatcttactaatttgataaaataataatatattactaaatgaagctaaaagtcatatattttgtatgaatactttatgttcaaaatattttttcgttacattttgttactacaattgttgttacttatatataattttcatttattgttcaaatagtttaacaattggatcttacataaaatattaacttatatctcataatatttcaatttatctcaaataataactttttttgttcaagttaagattgttactaattggtataatatttaatcacttttttttgaattatatatatatatatatatatatatatatatatatattacgtattcagatgttgaaaaacaaattatcatatgatatcttattcagtgttcagatctgcataccacatcttaatattcagacgtgcattcagattcagacgtcttaatcttaaaaaaacgaacgaggtcttaatatataaatatattttttataatttaaatttattcggttatagatttatacggttttattaaaaaaacgtctgtcaattttaaaatatccacgcctcttaacgtaaccgtcggctagtctcctactttaggccgccgtcacttctctcgttggtccgccactctccgctttgtaaccaccatcacaaccttcttcaccgcctcttacacccaaaagcaccgtaagtaccatgaccactaactctgtgcttgaacttattgtctaacaacaaacaacaatttcaaaagtttccaagtattaatattgcttaatatagttattagtttctaattcatccctaaacacttaagttatttttgactgtttgtttttttagtgttgcttgctcgatgaattaacataggcacttgttatatttttggtgtttttttctattagggtttggatatcgctatggaggagcaatcattctttaacaagttcttatcaaccttcgttccaattgcaagtaagtctttttttccttctctttttgtatatgtcttaaattttaatggatttaagttatatacacgaacagtataaagaattttttatagtaacagagaattttaacctgagatagcatgttacttaccatttttacctgattgtgtaaatattttttaaattgtcaatgcatacaacttaaactcaattttaataagttgcgcgagcataacggcatataactaaaaaagtgcttaaaagccaatatgcacttataacaagccaatccaaacaccatcataatatggtgataaatctgtaattgatgcgatgtgaaactgtggtttcagcacctccaacttagacaattaaccaatagacaaagtaccattggtgtgatataattgcattagaggtgaatacatgatttgaactttttgggttcgggatacccctgaacccactggccgttttagctacttggttcgaagtttaatatatgtacatatattgtgcatccgcccctgaagtgcattatatgcgtacgtttttatgtggttgggcaaggagtttactttcagttattccatggttaatttttggcagatagtctttctctgtccagtagtctgcataatgttgttggctttgctgctgtgacatgctcgctcgcgtgttattggtgcaacgagagaaattgtttgggcctttccatgctgcttttgctttatttttaattgggtgttattttatgctagtttaactttgtcttttggtattgaagatattatacaggctatcctaaggatcttggaccatcgagggttattcactttacctcagaacgggaatttgtccaacttctccatcaaggctaccctgtagttgttgcatttacgatcaagtaataaaagtttgtaatttctcttccctgtcctcctatcttctttagtttatcacattgatatctttcatgtaaatttttggatgctgtaggagtaactacaccaaacatcttgacaaagttctagaggagtctgcagctgagttttatccacatgtaaaatttttacgtgtaagacacttacgtggacctctcttttgagtacagatagaatataatgctagtttactgcaaaaagtcttttcaggcgtctgtactgtggccatctacgagtttgttacctctgttggagatatgcgagttttaagccaaaattgtcgttggtttaactttgtcctttatctattaccctaagcgcctattgtcctttaagtttgctaaagttgtgcagttcggaagatgcatgggtctttgtcgtcagtggggaaaaaagagactttgaccgaactgttcttcttctttgaagtcccaattccatttttccccaatttgtttaaactcatcagagccacatcttccttctcttgttgctatacatgccatttgcctttagtagcaactttaattttgccttttatcaattctttccttccaaattttgattgaaagagaataggagagggacaacgaggagggaaaaaaaaaattaattttttcgcatctccagattaacgaggaatggtcgatgagcttttgatctccagtgaattttatcaaatcaggcgacgaggatttggtgtatatatattttggacttgctcttgcccgtaaactatacgtatacctattaacccaatctaactttgaaagctcacctaattctgtgtttggaaattgtgaaacaaaatgtaagatctcttattattcactgcattggtgctgcaaaatttgagtaccggaagtttctttacctagttgactcagtgaaactaccattctatttgggtcttctgttaaatggactaaacctgcttaactcgcaaacttaaaggacaataagtgctcatggtaatatataaaggacaaagttagacctacctaaaagataagggacaattttgactaaaaattcggagatatgcaaaaggcctcattgttttgaattctgatagcataatgatgttttcccagcttatacataacatcgtccacgttttcattattattttgtattttcaggtcgaatgcccgaagtaccctggtttttgcataacaagacaaaaaaaggaatatccatttatagagatatttcatagtccagaacaggtacttctgtagtgtcgtggcattatatgtttatactagaagtggcttatgagtgccttaatagagatgtagaaaataagatgcattttctacaatctgatagaagattactgcgttcatctgattatatcttggttcctttcctcatgagagtgctcaaatttggcctacatgactgaagggagatgttgtattttttgtaaacaaacttattccttacaagaaatttgtgaaaaaggtacaaatgcagcagaaggatttatgtctctctgaactaaatacaagatgaaggaggtttgcatggctaaagtacactctgttataatggggaatttactagatttactttgtgattgaatttgttctgggtaacttatagagcaatattataggctatgtcgaatacggtgaagagagggagtagtttattcttctgtacttgtgtgcagtgaagtatgataggtttgtcatatgttgtttatgctgcatgcgtgaaggcttgacttattagaatgttaagaggtgcaaacatgtcttaagttatgcagaattctgccattggcttttgttgtgtctaatccctcctgacaagctcaagttacaaatgttcttgacctcagaagtaccgctaacatctcattatgaacttataacaagataatgaaaacttagctgaagcacaacaaaccaatcaaaactaaaagcttgtatctaccaactcaagctacagacaacataagatgagctaaaagcagccttctcagtgcaggttattgccatgaagttccaagagctattctcatattccctcttccctctctgttctatccaaagaatagctttaataatctcgaaagagaattgcaagtttgtattgcttgctcttatcttttgtctgttgtttcagggcataaaaaattactctctttatcatgtttactctctatgatctgtctgtattatagaagatgattgaattaatcatgaggtttccgtagtagacttaactgtttactattgcttgtagaagtggttgacttttcaatcatcatgtgggggtatacttaactgtttacttgtgctgtagaagtggttgacttttaaattatcctgaaatgggagtgtgatttcctttcctatttgtctcctttgttttaattaatgctgtgttagtttatactattacatgtctgtgtattggatttgtctctgcaacattctttgatagttctcacggtttgttgatacagatgctcgacgcttcgatgtttgttaactttgtggcttcacagctgcaaatttctttctgtacttttgttttcaattgagtgattctgatttgctctctaccaggcagctgctcagggcagggttgctgatcctaatattaccaaatacgcagtcaaagttttacctgtaagttttaaattcttattgcttttatccttgacttcttcttaaagaataatatcttaagtttgatcttttcaatgtctaccataaattatagtaactatcatttgtttcattagcttgtgatggttcgtgctcttgaaaagtttgctattgtgactagcataagctattagcacataccgagctgagttgttagcactgtcttaaacctatttgttcgcacctcggctaattccacggatacctactatctcctacgatcacatgtaccgggtaactttgtgcacgaaagtttggactcatggaaagaaatgacctagtgtttttgcctccgctgggatttgacctgagacctcatgattcagaacccactttattgatcactaggccacaccttagccatacaaaccaaaacttagccaaggaacagctaagtcctccgttgccaactggatccaattgctgcctttcttgtcctgcatttccatgcatattctcattgcagtatttcctagtgcaagaagaatgatcatcactgctgttactactgagtacatacttgttactagttattttacaatgtctagtatcgagttcacaaaacttatattctgccacctttccatatcaatcgcttgcttcatcatgcatctgctggataggttgtctgccctggtaatcttacctttctacctgattactggttaaactagatctgggaatcctggggtaaagttgtatacatgtgacctataggtcaagggttcaagccgtggaagcagcaactaatgctcatagggtaggctttttgcatcaccacaccttaggcgcgactcttcccctgcatgaacgcgggattctttgtgtactgggctgctctttttatatatatctgagtgtgagctatatcatgggtaacagaataagaacatggtggaaagctgtgtataaaccaagtttgagacctcttgtcttgtatttgaagtggttctgattattaaattacttgtaatttcagttcaactatgatctcagtgcttatggatttcgtgagtatttcaaaaggcatggagttcgaacatcagattccaattaaaagttaaggagtatccagcatggtatatgattttaccagtttggacaacttgcactggctttcttttaaattatcgagcacgaaagtgaaaaagctgtttcaaaacgagatctcctttgcctctccagaactcgaacttaagtttttttgaaaaataggcactgttattcttccatgaattttgctttttccaaatccttttcaacagtaatagccatttgtgacacaagctggtagagtgtgataaagaacttaaacttgaagctgagctcatattagttggctcgtcagatacagaagtttcgatgtttataacttgtgaaagatctcgcggaattcagtagctatcagggatgttacgaccaatgcagactacgatggatgagttactgatttatgaagtacaatttcttgtacaacttgtaaagaataatgttcttgtttccctctattcagtacccttttgaatatcttggtcctgtggtactaaattaaattgggacttctctttcttgccttgttaagtatagcagattagagagaaatgtaaccagcccatgtagaacatttatgaataaaatcttctataatgacctttttttctagtgtttggttatttcaagctgttgaattaatgtgttatccttaaatacatgttactatggaggttgaaaaagagcttagttcatttattgatgtaaatcactgatatttaaattatggtaagaattaatttattaatttatgctagtatttagagaaagcagtgattttgtgtagcatgttatggtctacactcttatgatagtgagaggtttagcctgttctaagccctctcatgatgcttagtagatttaaatgtacagcaaaacactaaaacaggaaaggagagaagcagaaaaaggcagagttacttgctcacttaatactagggttgtttgtcggtcagtatggtacgctatttagacatttcgattcgtattttcgatattcggtttcttaaaatgtatatcaataccgtacgtaattatattaaatatggttcggaccaccatcattctcaccaaaagtcaacactctatctacctcaacttgccaccccatcaccaacaactatcatagccggcactgaccatcattataacctaccaccacccatccaccaccttccttaatcccaactactatcaccaccaccaccatcctcaatcataatcgccaccactaccaatcactactagctactagtatgaaccaccatcatcaaccaaaactaccaccaactatcgcctctaatccgtattcaccgttagccatcactaccaacaactattatattttaaaatattatatattttattgatagaatgttagattagttatttcatttgaattttatgttaattaattttcagaaaaagataaattttatacattaagatgttaaaaatcaaacagtcttaattatttctatgtatatcttaatacacatcttaatatattcagatgtgtattcagatttgagacgtcttaatcttaaaaaaaaaaaaccaaatgaggccttaattccatcaatttttcagttgtacctccctacaacagagatatggacgaatatggaatacgtatttatgaaagcaaatttaataaaataataatacgtagaggtgtacgcttttgaaacagtaaaataataccgtatttagaactttagctaaagttcgtcttttaatctctaaaggatttatataacacagtcagacttttttataatattcttagataacaacacttaaatataaaagccaagtttttttggaatcaatttcatgttatattataatatatgctctctataacaacacttcactataatatccaaaaatattcggagcaaacgagactgttatagaaaggtttgactgtaaagcttcttggcaaggataaagttttttattaacaccaaattagtaagaaaataccattaaggatatgaattatgagcttcattctatatattgactataggaagttatttatacaatcacatcattatacataaaaattaataaatttgtataaaaatattaattaaaaaaattatatccaaaatatccgttaaacgtatgattaataatctactaaaatttcaccacgggttcaataacattgataatataccttattttatctaattgtttctataatttccacttgttggggccacagacaattaataggtcgaaggtgagagataattttataattaattattttgttacatagaggcttctgtagtaagtatatatcgataacaaatgaaaatgattatcctccttttagaaagacattgtcctcatatcttgaaactggacacgtggataattgagtagagagatagcaaagttaatattatcctcatattaaattaattatttttattttatttttatcttacctttatatataataattttatttcgtatcttttttttaataatattacataacataattaagtctgtactcgtagtactccatgcagatgagagtgtactgtactcgtagttttcaagaaatttgcttcattctgtacacgtggttgcaggctggatcctgcatggattgttgtacctttttaatatatacaaaataaataaattaatgtaagtgtactttaaaatttaatgacagtaagaaaaaaattacgaagtttacagtgtacttttatttatttacttgacagttgtcacagaaattttagaaatattctccatcttatatataacacagctggcagataaaaagtagtagtatacatttttaatatataatgatgaaaaattatataattcaagaaaaatattcataatttagaactttaaataaaataaaacttacaagattttaaaaattatacaaaaataaattatgtgacaccatgtaaaaagatatgttaatatttacgaatgttacacaaaatatgtaattgtgtttgaccgagtatattgtttaagaaaataataaataatttaaaacacgtcacatttattttcgtaaatagtataaaattatgtaactaaaaacaaaataagtaatttaaatttaaactattcttaaggatatagaaaatcatcccaattctatatataacgttcttcttgcttgattctttttgccaacttagtcaaagaacaaaacgtcattatatattttatattgtgtcaatataaaactcttgcattattaaaataataaacttattaagaattttgtcccccagcacttaaaatcattggaagataatataaagcatgaatatgtccaaagatttttaattatataataagtaattagataccttttaaacattctaggaacttttactagaattttttggcgtataatggaagaaaaatactctactttaatatattataattaaacgaaggataaagccaatatttggacgcaattgcttctaattattaccaacttaatcaaaattaattactattactaattaaaaaaaattatgttgtccccattataatatcccataataatatacactttcctacaaagaatccattaaacattagggtaacgacctacaataatctgccgcacgcgttagtaaatcacattaagtttgacacgtcagagacgttaattgtgtgtactttgactaatttaattcaaaacagtaattagatggctactccactcggcactatgggatcactaaggccgatattcgtccctactcgacaggtgggtcttgtgctcaagcttcctttgatcgacgtttatcaaaaatggattcataatttcttaataagtttaactttcaattagggtcgaatttgatatttgataaaacctaagtaatccaacgcccccccccccctcctcccatatatttgataaaacatagttgtatttgtgtatgaacagaatttagaggcgaaatcaagatttgaaccttatgtgttcgaaattttagtatttttaaaaaattgtgttctaaattaataatatacttatataattaataaatgtcttgcaaaaaacagagtcgggctaaaactactcgattcgatcaaactcgcgaccggaagactagctccgcccgtaagtatgatggttaggaaaatcctagtaattagtaaaatgaaccgtgattattactcatgcttagtggagtgaattaaaggtgtaaattatgattctccactatataactcaatttcgatatttttaattaaaagtgaaaagactccattcattctatcacaatccttatccataaaaaaagcaatttcaccgtcaagtaaaaggagtaataagaagataaaagtcataaaggttagtgccatttaccatgattatgactatcacttggtcccaagttaatgaaaacatgtaacgtggtaataatcccacctttttatatgtggtaatggtgatttagtggaagtgaggatcataattaccatccagctaaaaagatttatattcttttcggttcacgataagtaatttttgacttttttttttgtgatctaaaataagtaatttttttagatttcaagaatgaattaattatttttttcctacattgcccttgaagtaaataatgttggagtatgtgttaggactaagggtgttcataaaaatccgaaaaatcgaaccaaaccaaaaactgaaccaaaccaataaccaaaccaaaccaaaaaccgaaccaaaccgaccaaaaaatcaatactttttaggtttgtttggttttgattttaataaaaaataaccgagaaaaaccaaatcaaactgactataaaagtagctatttaaatttatatcgcacctatatatatgtatatttttatataaagtttctaaaattttatggtacatattagccatttgtttttttagtctagtcctttgctattataataatctaattatttgctttctagtttgattggtagtttcttttgctaaatacaagaatttattttatgttaaaaataatcgatttttaattgagtacgtaacttattcatcactatttgagtcaataatcatcaatatatcttggtaaataatagatttctcaaagagcaattgatttgatagcgttacgttgaaaatgtagttgccggaatacgcgtttggtagtttatgtctcataaaaaatcgaaaaaccgacaaaattcgaatcgataaaaagccgacttaattggtttggtttggttccaatatttgaaagtgacttacttggtttggtttttttagggaaaaaccgactcaaaccgaaccatgaacaccctagttaggactatttatgtgaaaagatcgtaaaaactaatatgttcaatttcattgctaattaatgttaaaatgtaaatttcttaatatatatggaaaaaaatcaaaaaatcgcttattttggaccgaagagagtaatactccctctggtccacaataagtgattttttaactgttattaagaaattcaccttttaacattaattagcaataaaattgaccatattaaccttactatctctttacataaactcccctaacacatacttcaacactatttactccaagggcaatgcaggtaaaaaataattaattcatttttgaaatatcaaaacatcacttattttggaccacgaaaaaatagccaaaaaatcacttattgtagacctgaaggaatagtgtttaaggcctaatttttttgttaagattaagacgtctgaatctgaatacacatctgaatatcaagatgtgtattaagattaagacatctgaatctgaatacacatatgaatatattaagatatgtaataagatctgaatggaaatagttaagactgtttgatttttaacatctgaatgtataaaaattacctttatttgaaaattaataaacataaaattcaaatgaaatactaactaatctaatattctatcaataaaatatatagttttttaaaatatgatagatattggtggtgatagctaacaggtgatagaggcagtagttggtggtagttttggttgaggattgtggttcatgctagtagctagtagtgattggtaatggtggcgattatgattgcggatggtggtggtgggtagtgatagttaataatagtgggtggtggcaatagttgtgacttagaaatctggtgggttggtggtggtaggttataataatggggaatgtcagttgtggttgttgatggtgatggagtggtagttgtggtaattgaggtggatgggtgttgattgtgggtgagaatgatatatggtggtcgaaggtggtggggatagtggatggtgatggtcgataatggtggcagctatgattgaggatgatggtggtgtgatggtggtggaggtggtggtgggggtggtggagatggttgagtatggtggtgatggtggtagttgataacggtaggcagttgcggcagttaataatgaatatgtgatagcaacttaatgaaattaagtctctattataaatatcaattatacagacctattcagacccgttaagtggttgtgaagtataaacaaacacacttaatgattaagatctgaataattaagattcagattttaaaaacaacgcacttaatgtctgaaatctgaatgatgaagattcagacctccattaagtgcaaacaaatgaggcctaactttagaaatcaaagattttgactagtaggtgtgtgcacacgttcacttaattagtgaaagtaattagtactttaatctatcttaaattagctttttgacacgaaagcaagaagcttttatgtacttaagttataactagtaatgattttcttctcacaatcaaacctagttttttttacgaggttaatgatggctatgagctttaagccagacgcaaggggtgtgggacagggcttggagtcttgcaaatgagttcgagtaattccaagatgtatttagtctgagtcaagactagagaagttgatgtacgtttgacttcgattcctaaaccttcatcaccatcagcatttggtactctctcgatagcttcaatagttcactgaaagactttggtgtaataaaccgcaagcccttcagaaagaaagtctgtaggattctttcatagaaatcgcaaaagggatatgttgctgccattttgaaaggactaaaaagcaccgaagtaatgcctaaacccaatgatttaaaataaaataaagataaaggatcccagaacaaggaaacaccttttttattgtcttaataactggatcagactgaagaatccaaattcattttaaatgagacaaacataaaaggaggaaagaccgctcaataaatgaaattgccgatagattttcctttgaactgtttgaaagttatccaacttgagttatgagagtacgaatggtttctttttcatttttaagaagaaagaacaaaaaaaaaagacttacatctttaattgatttgatcattttgtggacccagttgtcatttcttagatagaatttcatacagagacaaaagatcgaattactgtgcctatcttgggggtcgttacttttggtggtctttcattttggtcctcttcttgttctattgatcagaagcatccagcaacaccataccgatttagaattcgattctaagggctaagtccccccctttacttttcttcctggccgtgtgtgggccacacttcagaaaggccaaaaagggggtctcctatttctcgtcccatagagaatctctgtattgcgaatcgctcaaaccagcctaagatagggctggctctgaggccatctcttttgatctggctcaaatacctatttaaggtattctcagaaagcgcagcctccctaatagggtggttaaagatgaggccgcagatttctgacttgcaagccataaccatacggggggaaaacccatcccgcaccaatgctgcttctatcttttttttccagcagcatttgtttctccaacatacccaaaaagggcgggaggtgcctggcctcgttcctaccaatgaaatagagcgacgatcattgttgaagctctaccctcctttggatatcaggaaggagaggttgagctaatttcggaacgagaacctcgcgtggaatgggtgtaacctcgggctcgggaaggcgggttctggttctatgggaggagagaaatcaagagcgccagacgaggaaccccctcctcgtcgtacgcggctatgaagcattcaagatactcatttgttgaataaaaacttgtcataatcagcacgaagagagcgcccccaacccaaaaggtttctttagaaaagctctttattcctcctacttatggtagtcgtggttgattcgaggatcttacgcggcggagcaaactcttctatcgtcttgcattttctctggcggacccctcccccggtccatcatactggagcaattcgagaagaataattaggctcaaattctatcctttctacaatgcctatagacaaagtgcttcgtttcagatcaattcttcgctgcattcgcttcgatccaccccctcggtgaaaaaccgtaatacgccctgaggaattcctagcactagacttccctgtactcaaagtgaattgtctaagtgctctcttttataatactttttgtaaattttgccactcaaaatattgctgtagtaacgatttttttaaaaatctttggtggccataatgatcgcgtggcttatttaatttttatattatttttcagacatatacaaaacttgatctttttcgttttctgtttattatatttattggaatatatttgagttttattaaaaattattgttgtcattctcaatgttacttattttgtatttcttttgatttacttaatctactatcgtagtcttaggaatataattaaggtcataacgtaatgttatacagctaattaaaggcaattttggattgatatatacatcattcttttcctcatttgcaaaaaggaaaagagataaaaaaaacgtcatcttcaattttatctttcttttgatgtgattctagtaaaatatctctttctttcaaccaatccaagtaggcgtttgcataagtattgtaaaattcgaaaaaattgtgaaatttttttttaagtgaaaatgatatttgaaatttagagttgtgtttggacataaatttcagtttgggttgtttttgaagttttgtaagtgatttgagtgaaaattttgaaaaacatctttttgcagtttttcaaattttcgaaaattttcaaattgcatcttcaagtgaaaattgaaattttatgaacaaatgctgatttcgaaaaaaagtgaaattttttaaaataaatcttccatcaaattttatgtccaaacgggcacttaatcttaccaaatatttcaaattttggaattatcatcagaacttgaacatattatagtatatggatgtttttaggagctttactaattaactcaaaaatgcagttcaaattcattttgttaagaatcatgtcgcaatcaaagcacaaagggttcacaatttgcattaacgaatgttgtcgttgggatattgctacatggaccggcttggttcggtttttatcaaaaccaaatcaaaccaactacattggtttggattggttcggttttgtcaagtttgaagggttttcgatttttttgttacatgaatatcattccaatcttactttgttaaagtaatagataaaattttgataagtgaatatatgtttagtaaatattgaaaaaattaacaaatatatgatctattagaatattctaatgggaaattattatttagtaacacatgatagttattttcttagtcgtctaacaataattttcattaatgtacgctttcaaggttaatacatgagaagattccaaatatttcaacattttttaaagaagattcaatataaagtcttaagaatatatgaaaattatatatttatatgtcggtttggtccggattttttttactcaataccaaatagagtcaaactaaacctaatcgaggtttttaatctgtttgatttgattttttgatttggtacagttttttggttaggtttgaacacccctattgctaactaataatgcaaataaatcgacttgtccttcaatactcttttgaaaatgatgtcgtttttgcccatctttactttttctatttggggcaaatttacttttttgtgatgttagaaaatgtataatagcatcgaatgtctcactaatgcactattaattcgagctaccacatctttgagtaaataccttggttttcctatgttccataagagatccagtagctttgactttcagttcattatagacattatgctatccaagctggttggctggaaaacaaattgtctcaacatgactgataggaccgttatggataaatcatcccttaatagtatctctaaccatgtcatgcaatatatcaatttgtccacaaaaatcaccaagcaaattgataaaattcagagaaatttcatttggggcactaccccaaataagaaaaaaaaaatgcacctggttatttgggatatggtcacaaagaagaaggtcagttgggggctagggctccaaaaagcagaattgaagaacaaaccagcctatactaatctagcctggagaatctatcaccacacgtcaagcttatgggctagagtttttatttcttagcattataattggaaccatacccccaaaacccctaaatctcccacatggcaatgcatccttaaagattgggatacatgcagaaaggctagcagatgtgtggtccacaagggcaacagggtaagcttcctgaatgatgcttggatccctaatcagccagccacttgggatattgtagaaggtccccttaccccaaacgacataactgtcaaagtggatactgtctacaactcaggaaactaggacctctattccatctctatggatctgcctacaagtatctctaatatgatcaattctgtcttcattcctcccaaccctaccaaggaagacaagctaatctggggattgactcctagtgggtctttcaccaataactctgcctacactttccttagcaataacaagaagaactttggaaatgaggaggaagggacctttaattggatctggaaattacaagctcctaacaatgtcatgaacttcatctagcttctttctcaaaataggttacctacatgagcccaccttcatagaattgggattaactgtaactcacaatgttgcttctgccaaagtattaaagaaacaattgaccacatcttctttgaatgcataaatgcggctcaattctggcaggcgttactatttaaggcttccatcgagagtagccaacagaatctcattttctcatctcaacaatgaccatcaactaggaataaacttagatacattccctttaatgaaaacattccttgggagaacattcttcccttccgtttctggtacatctggctatgaaggaatcgcaaccttttcaacaacaaaaaatatagaatcagcacctccaacaccatctctaaagcaaatgaatattttatggtggcgaaaagtgtcaccatcaagaagcctttccaaaccattgtgaaatgggaatcccccgtgagagagtactataagctgaatacagatggggccgctaggggtaatccaggcataggaggaatatgtggagttcaggaaccataaaagtgactggattatggggtatatggagaatataccacatacaaccaacaccatggttgaactgaaagctctcctaagagggctacagctggctgagaaaaatggatggatccctttggacatcaacacagactccgcagaaataatccaaatgctactcacaggtaacttaacttatgatcccatgatttgtgaatgcaggttgttaatgtaaaggatggatagagtcgtggtaaggcatacatacagagagcagaatagggtggcagatgttatagcaaaaaggcagcaaagccaaattttttgggaagatccagcttgctagcagttcctccgatgtttgcaaatgatgtattttgggcagacatcctaggaactgaagttgttagaaaatttttggcatgcaatattgatattgtatctcaaaacatcgcactaatgggggaattacagtaccccggctatgtcagtactttgtaatgtattttctagtttaatcgttatatatatatataaattcctcttttaaccaaaaaaaaaagaacaatgtagtaacttcagctacaacaaaccctaaaatagtataataaaataattattttgctaatgatatattttgcataacatgaattgaaaaactaggtatgttgtcgatatcgacaacagcttttgctgaagttattgtagcaactcctgtatctattgatttttgcaccttctatatgttgattcaaaattttcctcacgattttttcattacgattttctattcgagaacactgtcctatacattttgatagtagtatctcactattatacaattcctacattagaattctagagttgcgtaattttgattttatgttacagtcagtaacgtttatgattatctatacgataaaataaattatcaacaatccaaaatgataatcagaaaaaaaaaatggaatttaacctttcaaatagttggattaaagtagttgacccactaagatttgccgtatacctatgaatttataataaaaatagtttactaggtattaagcaaataataataatacttttattgatgctacttttactttacgtttttttttttgattctccgacaatcttgaactcaattgacctacttcttttaactcaatatatataaataattcttacctttatctttttccaataatgtaatctttttatagcacagttattttgttaagttaggtttacataaaggtatatactttactatataggatcatcaaaatggaaaaattgattgtttttttcatctttttcctatcttttttttatttatttatttattttattttataaaaaaaatattattagtattaaagctgctcctattttataaaaagaataagaagaaataaagtcgatcattggccagctttggaagtatgaatagaatccaatccaagcatgcttattggatttcttataaaaagaataagaaaacataagcactttttatttttatatttatattttatattttgtattttggttattgtggggtcttatagccgatgcttcctcgaagtttcatatttgatattttagtttaaatacaatttttctctctctatccttttaaaaggtgaagcataatattttttatccaaagcaatacttgaatttcgtctttctttcttgtaaaaattaagatattttctattacattgaggttattgttaaaattttcgcaataaaaaaaaagttttgcatacaaaattcaagaaatatgatggacgaacattcaccatggatgctttagcatttcaatttgaagagaaaacgatacattgaaatagtcaattctttgatatatatatattagacgaaagaattattgctatgagtattaatttgtttatgtatttctttgtatattaaaatatttatactaaaatcattattaaatgttacttattatgaaaatatctttattattaaactttacttatttcgactaaaaaaaaaagaaaatatctttattaaataggaattatattgaaatgtcacatttgaaaatttatattttatctttggtatcagagctagacagggatatatatatatatatatatatagagagagagagagctcaataatggacaaaacaacattataaatattgtttagattcatgtatacacaagaaggtaggataaggagacagcttttgtttttgattgtttttttttggaaaattttaaaaaggagatcttgtaggcgtttggacataaaaattgtaaaaacaaagtgaaaaaatttcaaataaaaatagtatttaaaaattgtgtttggacatgaatataattttgggctgtttttgaatttttgtgagtgatgtgaagtgaaaattttaaaaaatagttttttgaaatttttcaaattttcgaaaaattttaaaattcatcttcaaatgtcaaaattccgtggcgaaacactagtttcgaaagaaagtgaaaaacattttgaaaaaagaaagcttttttataggtcaaacgggcctcttatatcagcaaaacacgagagaattgtaaatagaacctaactgctggccagacaattaagcaattaatcacagaattgaagaaacaaccatatattagtgaattgtaatcaaggttaagctaacgttaaacaacaatattcatggctaaatcacaactccagaacaattgatttttagctactcatgatgtaatctaacaaattcataagtgttaaataattgaaaatactagaaaaagatgaagaaaactgagatctcttcgcttcctaatgttctcgtgtgtcttctccttcaaaagtggtgtcacccctttagaaataggtttagtcttgcttttatacatgttgggtaggtctagggccgaattaaccatgtcccgagcgaaattggataaaatcccatcactggcgccctgcttagcgcacggcgctctccacggcgctgcctggcttgagtacactgtttcgagtgccacacgtagctcagggcgctgcctatggcgctccactatcccatttttctgtttttgtccgttttggctctaatttcgcacatttctcccctaattactcccggatcattcctacacataaaaacacttcaaactaatataaattaactcatttcacatccaaaatccataaaacaaaagtaaaatatgaagcgatatacatacaaatatatatactttaagctaaacatcaattttacctgtggcgactttatttgccttattaaaatgtatgcataaaagaagccatagcttcaaactggtgtatatttagtgaaattcaacatgactaaataaatcataagtaaatgacatttctcgttcccaaacatataaaagatcttttcaatattattctcaattatttttgaactttgattgttggtcagttaagaaatcacatatttagaagatgaaagctgcagaaatgacgacgatgaagtgaatgtgcgggcacacaaagatggataagattaggaatgaagatattcaggagaaggtgggcgtagcgcctatgaatgacaagatgtgggaagcgaggctcagatggttcgagtacgtgcggaagagaagcccagaagcaccggtaaggatgtgtgagcggttggctttgactggtacgagaagaggtaaagggcggcctaagaattattggggagaggtgatcaggcaggtcatgacatggcttcagatttccgagaacatgacccttgataggaagatataaaggtcgagcattagagttgtatgttaggaggtaattgaatatttttcaacatcgttccaggtgagagactagtctgaaagggttttgtcttagactactaaagtactagtggttaatgttgtgctcgtactattcttccatttttcatattaccaggccttatttacttgttattgttaaatgcttttcgtctattttctggtcgttatgttgttattattactgtgctttctgttgatggtactggtttattatctctgttcgtcttcttgagccgagggtctttcagaaacaacctctttactccccggggtaagagtaagatctgcatactcactattctccccagaccctacttatgagattagactgaattgttgttgttgttatttttgaactctggttggaagagaaattctaattgaaaatttttgatcagaagttgatttattttcttcagcattttacaaatttcatgttacatataaactatatatcaactgtcaatttcaattacgccaattccaattttatttattttattttattttgcttgctaaaagtcaatattagaaagctctgacaaaaaattccaaaattaattatatcgtcatgttaaactaggattaaatatgaaatcatatcaagtaggcttatcttttctatttttcttgaactgttgacaaccttgcaaaaaataaaaaaggacctctcgatattacgagtcacatttttttataataatctattttatcctgagttctcgattaatttggttcattttaagtcaccgaaaaaagacgtaattcattatcttttacttattaaataatttatattcactttttattaaaaaaagaagactttgagtcattttcaagaaaaattttaataccaaagtattatttatttagcttcctctaatatcaaaataaaaacaaaagaagagtgtaatcaagatttattgttcaggaaattattcaaaactaatatggaatattgttttccagtggcgacgatatgtgagtggaaaattactcaagcccaacatataaagaagcccaaaataccttaacgcccctttaaatttgacgcttattattagttataattttaaattattcgtggctttaattacctttttcaatttgtttttttgagagccattatccccctggacgctgatatgacaaaaagtgtgtgcactcgcctgccacgtggatttttttgtatatgtgatattttttaaaaataaaatatatttttaccattttaagtatgttacttttttggataactttttccaaatacgatttataatagaacttggctataactacattatttaggctaaatattttcatttggctaaaaataataagttttagttaatctttttttgaatttgaataaatatttattcaattgaataaaatataatttagatgccttgactatttatttcaattgattatttgtaaatatactcatgatagttatctcatactttttattattattttttcttcttgtaatccttttgttatatcaaggatttaaatttgtacttacaattatcaaattttcatatgaatataatggagggaggtaattagtcaatttgacataaatactttgtttagaggtccattatttcttgtcagaagatgtccataggtttaaacagaaatttcaaataactaaaccaattaatctgaaatttctaagaaaacgaactaaactgtgattatttggttatttcataaccgaaaaattgaaccgagtttttataatccaattcgaagtgctgatgtcagaagaaacgaaaagtcatgtgtattttttttataactttttagatgccttgactatttatttaattgtataaatctttattttaggtcaaattcaaaaaatttaactaaaactttattatttttagccaataaatatttagcctaactaatatgttctatccaagttttttataaattgtatttgaaaaaaattataaaaagcaacataaataaaaagtaaaaatatattattttttgaaaaaatgtcacatatacatgaaaattcacgtggtaggcgagtgtacccacactctttgccacatcaggtccaggagagtaatggctctcaaaaggccaagttgagggaggcaattaagaccacgaataatttaaggctataataataatacgtgtcaagtttaagagggtgttaaggtattttgcctaaaaacaatatccacttattcaaaatgggaaaaaggccaaattttgccctctattatgcgaaaagggacaattttaccgacattacacaagtggaaatttggccctttctaaattcttcagagtttactattgttgttttagccgtttgtaacacattatttaaaatatagaagagttaccctaatagtcgattgtaatatgtataattctgtataatcggtgtataatttatatatatcgatttgaaaaactaagtagtaaattcgggttattttataaatcccaaacatctttaatttttgtaaattatttaaagtgtagctagtttggcaaatattagagtgaaattttgaagttgttatttcttcagactttcagatttgagattaaattatgccaaagcctaaactgaaaagaatataaaagggcatttgcatctatactcttatattcgctttgcaaaataaattgcaagcgtacccacttttcgcgtatcttcggcatacgggcctgaaatagcaaaggtaatcacacaaattcggcattctagtagacaggcctgaagtagcaaaaattgatgaaccaagtgttgggtgaagtttttgtttgtaattgctgaactttaagcattctagtagctgaagttttgttctctatttgctgaagtttttgtttgtaattgctgaatttaagcattctagtagctgaagttttgttctctatttatgaattcagcatgttttagctgaagctttgttatgtttgtgcagggccgaatttgttttgtatttgctgaacttcagcattttaggagctgaagtttttgtttatatttgctgaacttcagcattcttaacttttgctgcttataaccaaaagttaaggatggagattgcaaaatggaagaagagttataacaagcagaagagactaattcaaaatttggagggagttgaaggacataagcaacaacgtttggacgttataaggttgaagacaagagctttctgtatttatttgtttggaagttattaggttggtcgaagtacataagcatcgaacattatcttcagcagaaagttcatccctatgaactgagtttcatagcagcaccacaacagcagaagaacgaaggaggagaaggaggaggagaaagggagctgaagttattttaaaaagtgcgtacaagttaaaactttttttaaaaaagggtataggttaaatgggggcgaccaaatagggcgcttcgtgcaatttttacgaggaaatggtgcaaggtgataacacataacatgaattgtcaatttttagccttataattttgacaaagatagccccaaacaattggcattctatagccaaatcttcaaaagcctaccctcttatttattctctctcaaataattggcccaaactgtctgcttcccccccccatcctcgccgctcattctcttgttagtgcttccctcccctttctctccttgtatttcttcttctaagtcttctctttcgctctcatagtttagcgaaaattgttgtatgcaaaaaaaatcagtgggatgaaaaggtaaggttgatcttacatcagagaaacagaagcaaaaattaagagagaaaaaatacatttcaactttatttttcttctctcttgttttttggttagattgatcaagtgagtgtgattgaaattggttgaaaaatgaggttatatacaaaatttgagcaatattaaaagtgatttagactattttgataaaaaaccagacctaaaaatccaacggcgacatgtgtatatcatgttatatcgtatacatctatgtatatcacacaggacatttgtgtatattactttgtatatcatgtatacaacattatttagtatatgacattttttatcatatatatacacaaacttttatggatatatacatatacacatgatatcatgagatatcactagtacgagatatacacgagatacaataggggatacacatgtggatgtcttgaacttcagttttcaatctgaaatgtgttatacaaagaagaaaataaaattttaacacactttttgatatacatattattagtatgttatacactgtgatatacataatataatattattgtgttatatatatttcgatatacagataaaactagaaaaataataataaaatgtttgggatttttttccaatacctgaaggaatagaacctaattttaggatgatggtttctatgagagaaagagagaaggttttaaatattttttgctctttttaaggaaaataattttgatggggcttatttttaggatggtggttgaatcattagaagagagaatataatttttggggactttaataactatcacatttcaaaagaaatataaaaattcttagcatgaaattcaatattacaaatatggcaggaaattatttatatttgtaacatacagttccattaaaataagaatattaattattaatctctaaacataagcaatttggatgaaaaattaataattattgtacaaaaattatgtattttttttctctttattgattagctttccttctttttcttcgtcttcttagttttgttttctgtcgaagccaatatatttttaaatttgttccattcgttttatttttaattatctttcttaagtttttctcttacttctttcttactttctcaacataaagatcttacttcgataatgatatacattaatatatacaatacgtatatattaacgtatattttgaattaacacatataaaatatacaaaacatatacataaaaaatacatcttcaattaagatgacacttagacatgtgcaatatacataaaaaaatatatcttaaatttaattaagattgtatataaatatacaaagaacaatatatacaaataacaatatatatatataatatatatatatatatatatatatatattatataataacttgacatataaaatacatcctgaattaaaatggcacttgacatataaaatatatttgaaatatacattaaaaatacttcttaaaataagatggcacttcacaaataaatatacaaaaattatatacataaaatacattttgaattaaagtgatacttgatatacagagcataaaagatgtataaatcaatatatcttgatttaggtggcattcaaatatgcatcagattttcaaaaatggagtgaagaagatgaatgttgtaaaggaagaatgaagatggacaaaaaaaatacttcccatgattagtgagaaagttaacttattagatgttacgcttaagttttataacgtgctattaatgtaaaaaaaattgctctttatgaaataaacaataaatgatgctattgttataaataatagttaaaaagggatcaagcgtataaaaaactctataattttaagctaccatatgtaaaatcataaaacgttagcttttttatgccaattgttgaacctaattgtagcctgacgactcaaagcaaggtcgaaatcctaaatcctcaaaccgaatgtctaaagctttcaaagctgaggtctgaagccaacttcagacccataggacctcatcaatgggctggactttcaacccaagttacatttacccttcgagcccaattgctgttgctttgggccaaaaattgaataaatatgacactttttgggtcggtctttaacttttgaccctctagaacttcaaggtcaaagcttaaaaatattgtttatgggataagttaggggcaaaaattcaagaccatccactttaagggctatttgttagtgcccgcgctttgaccgtcagaggccatgtaacaggtcttcgagatcgtctaatgttagttgtaaaattgttttgcttacaacttgtttgaatacaatatttattttgattattacttaaacagcttgtttgaattgatgtttcttatccttttcataatgtattgtattatattgtactgtactgtatttgtattgtattgtttgatgagtacagcatttggatagattgtattgtttgccgtcgtttcataatgtcacgcaccaacaatatgaagaataaactcgcaacattagtaagaaaaaacaggatactaagtagaattattatataaaaaagtaggataaatgataaaaatgtgataatttaataataaggaaggcaacatgagagaaaaaaagcaaggaaacaatgtcaccacaccaaatccatcgttccataaagtggtacttttcgtcgttacgatagcgatacgatacaataaaatttagctacgaccgaggagttgttttcttaaaccaaactttgcaaattattaagtttattaagcgcacacgtgcatgaacatctgcttaaactctatactagaatttcttgtactatacatcaattttattatttccatgaaaatctaggtgatggtaaagaaacattgcacgtagaagtttcagtggcgaacccaggattttatgtaagcgggttcaattttagaattacaaaactttagtcgtaaaatagtaattgttaagtgagttcaaataaaatatttatacaaaatttatgcagctttaatccgaatatatgtatatacacaatattatttttcgatgaaatgggttcagttgaacccgcttaccaccacttgcgtccgccactgagatattgtagtagagactacttatattttgtcactcagtatcaagagatgggctaattgagattgaattatgtataatgaagtttaatttgtatgtagcgataaatgacttataattttaattaaaaaataaataatttttaactcagaaaaaaaggtgatataaaggtgctttaatcctaccaaaaagaaaagtaggtgaaagaaaaaatataaaactaatgaagaatttcataaaataataaattaaattaaaggcttaaaatggaaatgatttcaagatttgaaaggtttaggtcacccttttatttggatgatttgaggggttgggtttggtttgacctagctggtgtggctattatcatgcacctaacccaactggttctgttctatcccaaactaaataaattaaatatttaaaattcaaaagagtacaataagttgttaatataatgaagtggttaagtcttaaaagttcataaccaatgagcttttgtagtatttttactgtgtgactgttgtcttgtttagtaaagaatgaaagtggttaagatttccaataattagccatgtgattacttttgacttcggtgcacaaagcacttcgcgttcacgtagggtccaaaaagccgcactttatggagagtgatgtagcatcagtggctgagctgtccgaaaagccgcacttcatggagagtgatgtagtatcagtggctgagctgtccgaaaagccgcatttcatggagagtgatgtagtattagtggctgagctgtccaaaaagccgtacttcatggagagtgatgtagtatcagtggctgagctgtccgaaaagccgcacttcatggagagtgatgtagtatcagtggttgagctgtctgaaaagcgcatttcatggagagtgatgtagcatcagtggctaattccacagctcgaacccatgacttatgggaaaaattcaaaaatagccagatttacaagtggccattcaacaatagccacagtttcaaaagtaatcgaaatttagccacttttcatgtaaagataaatctgaacgaaaaactgttcaaaatccggaaaatactccaatataatatagtgaaattccaatataatatattggaacaccaatatattatactggagtttcagcaaaatataccggtccagcataatatgctggaagttcatacacatgtgctcgaatctccagtacattatgctggaactttccgcgtgttggaattccagataatatgctggaagttcatacacaggtgcaccgaactccagtatataatactagaccggtctctgttacagcaaaatagtggctatttttcaatgaccagttcgaaaactggctagtgcgttatttttacatgacttataggccacatgaagacaactgctccaaggctcctcttgatgaatcaagatttacatgctacatatatgcaaaattaagctctagtaactgaattggataaatcccattccttcaagcaagttatctaaagagcaaagaagttgttagaattttaatccaagtgacactttctaattcatagttttactatatcttatctaactagatatctatgacacaaaaataaaaagtatttttttttttacttttattgcaagttatagctggccgttatgttcattactaaacttacaaatataccaagaatcaaatagtccaagtaagataaattatggaaagaagaagtcattaaaaactttttgtactcatatacaaatttattcttcttgaaaatattctttcatttttttaaaccttatttccattttcatcaccctaattaagtacaatatcaagtttagtgcaattgcagttgaatgttagacatgtgcaggtatgaaaaaaggaaatagttgttgaaaacaaacttaattagtaaatagcactttgacaggtgccctaaaaagacccccctcccccccccccccaaccaaataaaatcaaatattaaagaaaacttccaagccaaactatctaactaatcttaaccccactaccctttatatattagcccctccatttcttgttcattctcataaactttttctccaaacaccagaataacaacaacaacaacatagtattctagaatccttatttgttttgttgaaaatgttaagaggtttcttgatttcatgcatgctgttttctctgtttgtgtcatccacatatgctcaatcatgcacaaagtacaactttacaagcaaccagatcttcacttcatgcagtgatttaccttacttgaactcattccttcactggaattatgatccttcttctaaaactgcgaaaatcgcctttcgacacactaagattacctcctcaagatgggtagcatgggctataaatccaactgctcaaggcatggttggttcacaagcattagttgcatatcaaaatcagatggaaaaatgagaatttatacatctcctatcacaagttatcaaacacagttacaagaagggaatctgagttttcctgtttctgatttatcagctacttattcgaataacgaaatcgccatttttgctacattaaaacttgataaatttaactctacaattgtaaaccaagtatggcaagaaggtccgctttcaggagattctcctgcaatgcatgatacttctggtgttaatgttcaatctgctggagctctaagccttctttctggacaatctaaaactactactactggagctgcaagctcacaatttaacaagaaaaatgtaagtcatttgatttattaatttcacgtatagttactgaactttattgtctctcctgctgagccgagagtctcctggaaacagtctctctacccttttcagggtaggtgtaaggtctgcgtatactctactctccccatacccactagtgagattttactgggtatgttgttgttgttgaagtatagttactgaactttatgtgttataacgataaagtcaaaaactattttatcacattaaggtagaattttaccaactataacactaaagtcaggaaggggagccttagttgctgccatgtgatcaggaggttacgagttcaaaccgtgaaaagagctctagcaaaaatgcagggtaaggctgcatacaatagacccttgtggtccggcccttcctcggaccctgtgcatagcagagcttagtgcaccggactgccctttttcttataagagtaaagtcagaaaatatttttgttactaaaatttattcattataacattaaagtcgcacttgatgggtagggttttatcgacgactttattgttatagtaaaaaaaattaagttattttaatgcgacaagaaatagtttatgtgactttaccagttataacggatacagtttaacgactttactgctatagtaagtaaaagtacaattacttttatagctaaaagttgttttgcaactttattgttatagtagataatgtttagtatacacgaaacggacaccttatcttgttgatgttattacgcgttgtgtttgcttcttttacttttaccttgagccgagaggtcatctcaaacaactctctaccttcacaagctaggctaaggtctgcgtaactgtactaacccaagatcatactttgtgggattacactgagtttgttgttgttgttggtcagtttattacactgagtttgttgttgttgttgttgttgaaactgaccgcattttttctttgaaaatattggtaataagttttgacttgaaattctgatttttcaatggattttttagcttcatggactgctaaatgcagtgagttgggggatcatgatgcctatagggatcttatttgcaaggtatttaaaggtgttttcagatcctgcttggttttacctacactccatttggcaaatcacagcttatgttattggtgttgctggttgggctactgtcttcaactggggagtgaatccctggtattcaatttactgtccacagaactattggcattgtcctgttttcccttgctaccccaggtaatttagtcattctctatagcaccattgtttcaagattttggctatcaacattgatttgttaatgccaaaaagtgattgtgtccggaacaacgtctctaccttcataagtaggagtaaggtctgcgcacacagtaccctccccatacccttgtggtatttcactgcgtttgttgttgttgctgatcaaaagtagctctctactatacgaaatatcttaataccttttgttatactttggctattcatacccttgttagcaaatcgtcttatttttatccgtgactttagtggtgtttctgagatatataacagagggtaatgtctgtatatattaccctcccagaccccactagtgggattttactaggtatgttgttgttgtataacagagggtaatataagatcatattaaaagtataggggtaaagttggaccttttcttgtttgacacgtggaattcacccggtccacgctggagctccattaaagtcaagggcaagctagttaacggcaagggtatgaatgtctcaaagtttaagggaaagaaaaaagtttaaataattcgtatattagaggggtaatttcgtaccttttttctatgttgctcggactctccgaaaatattgcggcaagtataacagcatcttgaagagtctgcgcaacttagctttgtcctattaaatatttgagtcataacattaaaaaaagggtagccaagtgcactaagctcccgctatgcgtggggtccgggaagggccggaccacaagggtctattgtacgcagccttaccctgcattctacaagaggctgtttccacggcttgaacataacattctaagtaagaaatgaagttgaaagggaggtttattttcaaccatctaaattgttaatttaactacaatgtgaatatttcctttgattacaggcttctgcaatgcttctgaggccaaaaagggatcacaaacacaggatttactggaacatttaccacagatcagttggatattcaattgttgtccttggaatcatcaacatattcaaaggtttgaacatcttgaatcctgagaacaaatggagaatagcttatattggaacactaattggtttaggaatcattgctgcattcttggaagttattacatggtgtgtggttataaagagaaacaaatctgttacaactgttgagaagaatacacaaggacaaggtttatatgaaacaaatggctataataatggctatggaaatggaactactaggatacattacagagtttaggcattgaaatattcttctgtattggagatagtttgatttgtctatttatgtagttcaaacttggatatgatgccagaggaatatttagataaagagcatcatggatgtttttttttttcttttgttcggttcgggttttattttctttaatttcagcggctccaccttctcaaggtaagggtaaagtctgcgtacacattacccttcccagagttttcttgaatttcagcctctataccttctcaggataggggtaaggtctgcgtacacactatctccgcagacctcaccgcgggttacagtaggtggtggttgttttttcggttcgagttttattttcttgaatttgttgttgatatttacatatgtactttattccttgtgcaatataaatcagggtgttcttttttctctttgtatgtttcggtgttttcgcattttcttattcagcttcaattcacaatattgactacaaaaaacaacaaccaatcacccagtataatccacaagtggctggggagggtaccgaaaatagcaacaaagaatatgaaaggggtactgataacaagtaatagcacaagaatatgaatgaagtactgctagccaattacggaattaccgatggcaagtaataaagaaataagacatgcgaatatagcaaataagaaaaaaaggataccgtactagcactaatactatcgaactatagaagacaaagggaaacgcacgactacctactaacctactaccctatcttcaacctccacacccttctatctagggtcatgtcctcggttagctcaagctgcgccatgtcccgtctgatcacctctcctcaagacttcattggcctacctctacccttcctctcacctccaaaggtcaacctctcacatctcctgactgggacatttgtgtttctcctcttaacatgcccgaaccatctcaaccttgcctccgcagaggccactcccacttgtcccgagtaacttcattcctaattttatccaacctagtatgccacacatccatctcaacatcctcatttctgctactttcatctgctagacataggagtttttgactggccaacactcagtcccatacaacatagtcggtctaaccactactttagaacttaccctttaagtctctgagtctcaagggcaccaatattgactacaaagataaagagatatatactgtagtagcctttatcattagcacaacaattactagattattaagtcaaaaaatcagatatagtgcaatcattagtgggagtagaagaacaacatttatcttctcaaactacttcaaaaaagttttaccaatcttaaaagtagaacaacaactaaataatatcatattatataagtataaaggtattccacaacaagttaataacaattatttctccaataatgcatcggacagtgtttgacaatgataagattgaagagaagttatatcaatgaagtctttttgtatcaaacaaactgatgtctttggcagaaataggccttataggaagcttcttatactatagaacaaaatctatcccattacataatatgtcattgaagtcactttccatcaaacaaactgatgtcgacgacggaaattggcctttcaggaagcttcttacactaaagaaccaaatctataacattatatggtctctgtatattgaaaaggatagtacagatgacttgcctggttaattaaaaccagcaataaatggtaagaagtgaatgtttcttggctaaataatgattgaatcctgaagatggagtcaggatacgaatagctatatcccgtttaatgatgaaattagaactggttctggtggtagcttcttctcattctgattcattcaaggccttgataaatgcatccttgagatgagcgtttgtagcagctacacgtcgagctgtgaggtcaaattctgaaccagatctgatgaagaaaatactatacatcagcgatatcaaactgtcggtctattattaaatcaatcaatcattcaactttgcctcgatcctaaaactattggggtcggctatctgaatttgctacatcttttccgctccatataggtgtatacctaaatatatcattgaacaatttgatttctatttctcttaggaacactgaactatacttcttttctctctatgtgaacatgaaacttcatctccttctatttcattatttggaaaagttcacgaggaatagagtgtgttactcacggatcaaacacgaaacctccagcttctttcactatcacagcaccacctgccacatccctgtatgtggaaacaaattgtcaccaatatgtgtatttgttatttactattaccaatgtcacatgttagcagactgaaaaagaattacaagccttaccaagggcctccaaattcaagttcatagaagagatcaagccttccacatgccaccccacagagattcaatgcacaagagccgcacatccggagggacctgacctgcaatataaagatcaaacaggttatttttattgtctgaacatatgtttagctgaaaatttggatttcttggcaggtgctgcgtcaccttgaaaagcaagctattgattctccctgtagtagcatctagagttaacctatcccgcttcgttccagcctgctccagtaaaataaatgtcagtaatttttcctagtatatcaaagaggtaaacagaaaaagtaaaccaacacactgataggcataaatccagctagctctaaaaaatattttccaaataaaatgtcacaggtcacaggaagtaagactttcaatataataggaggctgctagagatttgcaggaacagaaatatatcttggctaaggacaagcgagttcgagagttggacaagcaacataaccttttttccatattcacttaattgaccggtttatcctattcacatatttgtagagctcaggacagacgtcttgcttgaagtaaaataagtgaaggtattctaaacaaatgaccacactacaaccaaaaagaggatgcttacttcaccaattatgtgctaattccgagtttatcaaacagatggatgttcaattaattgaagtcaaaaaatattccaaaaacaattatctaaatttcatgttcttatcagcatagttacagcagaacagataaagtgaaattgttctttatccattatccaccgagtttcgaaggctgcagttggtctaaaggatcggccccagacggatttctcggtcatcaaaaaaaaaaaattgttctttatgtatcacattccattaaaaggtttctgcagggttgcaattataagcaataactgagaggtactattaaaaagcaacaatagagatggccaagtacctccgtagcaagaagagccttcacaagttcagactgtgaagatactgagggtattaaaacaatgcagaaaacttgtcagcgattgataggtagtagacatgatgttttaaaagctacaccacaatcaatatgcaacaatacctttgataggcttcccattgagaaaagcacctttcccgttgattgcagtgaaaagctgcatgtcaaaagtaaaaatcttgttactaacttgaattatcaattcattgattaacagctcctaatttcatcacaagtcaagatggccacaacaagttatcactattatgaaacggaaataaggttggttgttgtcacacttacattaggacctgtgtctcttaggaatattttattctggttagagacttgtataggtgttaggggtaaacgtgatttagtgaacctttattttataaagaatctcatatttgcttacaaagatatattattccgtattggaatgaactgaacctaaatatatagaaatgaatatagagtactcatacaatcgaactcaacaaatttggaatacaggcatagctgacagagattctcacctcatcaataattgggttgtaaacaacaccaactgtcggaatctttccaattgtaagaccaattgatacacagacaaaaggaaacctaaaataaatcaagttccacaaatcagcttgagcggcttcatgaatcataaaacaagctctattaaagtacggagaaatttatgcttacccatgcacaaagttagtcgttccgtcgagtggatcaactatccaagttggttcatcggtcagctcaaaattgccacaagcagcagttgtttcttcaccgatgaactaaagtgaagagatatagcagcaaagagccggaaacagatgagtaaaatcttcacaaaacagctaataacgtgatggaacgaagaatataagatatgaaagctaaccttatgacttgggaaatgttgcttgagatgattaaaaatgagatcttacatgccttatcagtctctgtgactaaatccacctacattggacgaataacataaatttaagtgtacaaaagacccatagaataaaacaagaaactgaaaagaccaagatttacatgtttcttcttgccaaaaaaaaagatgatttactttatgcaataaaaattcattcttaactaattcgtatgcgcacatttcatacctatatatgttttaaacattctaaaatattgtttacctacagctgtttccattgtgcttcctatgcaatataagtcaaactaaaaagaacaataaaccttcttcacccttctccttttccgaacaactcgaactacgccaccgaattccttcaaaaggtcagaggcggatgtagtgttttgactacaatacaattgaacccaatatattagacacggagtattgtgaaaaactactaaaatttcaatcatattaaactctgaacccataatttaaaggcacaacaagtttagtgctaaaaccattaaggttgaaccaattaagcttaagtccgtcgaatatgtatctgcagaaggtattttctatcgtttaagtgtaaaatattttgacttttataagaagcataagtagtttcctagttggataatagaccatatatactcaaattcaagccacaaacatggttcattctcttagtagtatctcaatatccgaaattatcctttatagaagcaacaaactgactagcaaattaagcagtcatagctcttcagtccaaaaatgaaagtaaactatgcttcctaaggggtgtgtagagggtgtggtggaatgcaggggtggatttaggggggcggaagggggttcgccgaaaaattacactgtacatataaggcaatatctgttttttacagctatatattaagttttgaatcccctcgacacagcccaaaagtgtagcttagtggtaaaggggattcaaatcctttgtaaggtcataggttcaactctcgctagccacaattgtttttaactttttcttttttgaacccacttggtggagatcctgcctccgccactggtgaaatgctaaaggttcctccacctttacgaagtctcaggttcgagtccggggacaaagtcctctttaatagggaagcgctaaaacccctatagtgcgctttttacagcacgaatctggattagtcgggacagtgattttcggacaccggatgattaagcaagaaaaaagctctttttaagcaaaaagacaacaaattgacagaaaaccataacaagaaaagccagaacagaaatgcttagccaaaaacaactaaacaaagcactaaccactcctttgtgctccacattcttagtctggtgaaatccttggcgaattaccttcaaaccccagaaatgcaaaaacaaagaaaccaataccaaattaaagctaaaaattgaatctttataatgtagctaaaattggttagacaagaaaccaataaaataacaagtaactgcaaaaaaaaggaaaaaaaaaaaatcaattgagtcaaatttaaaacagagaaatcaagatcaaataaaagctaaaaattgaatctttaaaatgtagctaaattgatcaaacaaaaaccaataaagtaactgcaaaaaaaataaaataaaaaagaagcaatttgggtaaaattagatttacatctccagctttcttagctgcttccaactgcaacatcaagaaactgttcaagtgaacctgaaattcaaaacaatggcatttaagaaataattcacatacaattacttatacaagaatatgggtaaaaaattagaattagagatgaaagggtctataccatcttgagccatctttgaaaaatttgattaattgagtgatgcgaagagaaagtgagaatatgatgtgaatatatatatatatatagagagagagaactttcacttaggcacatgaaagaccactatagacaaatacaactatgtatagacatattttgttggacctgatatacccctatgttcactcggattttgcattaattcaaaatataacaaattattaatataaataaaataaaagaggattttggatgggtcgggtaatggaattgagcaaatgaaccaatgtgaatggattcggacctcttaacggatagggatacaatcaaacttctctataacagtttagtctatattcatattttttgctactatagtaagttttattatagggagaaattcaaaataaccagatttacaagtggtcatttttaaaatagtcacagtttcaaaagtaatcgaaacttagcaattttttatgtaaagataaatttgaaagaaaagacgattcaaaatccggaaaatactccagcttaatataccggagttccagtataatataccagtccagtaaaatatactagaagttcatactaggtgctccaatctccagtatattatgctggaactttccagcgtttgtagttccagcataatatgttggaaattcatacacaagtgcatcgatctccagtatattatgctggaactttccgtgttacagcgaaacagtagctattttttaatgactttataaacgctgactatttttgaatgaccaatccgaaaactagctagctcgtgctattttacttgttatacaggacatatattataacataatataaaccccagaccatttacaaattaagggaaatttaacttggaggtggctatttttgaagaccaatccgaaaactaactagctcgtgctattttacttgttatacaggacatatattataataatataaaccccagaccatttacaaattaagggaaatttaacttggagatggctatttttgaatgaccaatccgaaaactaactagctcgtgctattttacttgttatagaggacatatattataacataatataaacccgataccgtttacaaattaagggaaatttaacttggagatgactatttttgaatgaccaatccgaaaactaattagctcgtgctattttacttgttatagaggacatatattataacataataaaacccgataccatttacaaattaagggaaatttaacttggagaccctttagaaagtagaggaatatctttatgggaaaataatgatgatactaaaaaataggaatcaaataccaaagcaagaatcccagaaagacaaggaaagggtagtttggtaaatccaacagacagacattcatggaatatgcctatgtacctgagtatatgctgtgttcgttattccctcgtgtccatattcttccacttttatcccccattcctctatatagcgaattaaaagtgttaatttaacataaacatatttattttttttaaaatcattaaaaatgatgatttactgttactacgatgcacaaaatatttgtaaaaatcaataataaaattactctctttaaaaaaaattagtaatacgataatacttttatttgagtgcacgtgtcgtgtgttcccaacattgaaaattataagtggtctggaatagcgaaaaagacatattatgaaaataacaccataaaagagaaaaaagggttacattatgtccttttataattttaaatttaaaaaaataattttttttagattttttatgtgtaaaagacagatctcttacgtgtaaaaataaatttttcatatgtaaaaacagtcataaaactaaaaataaatttgtaaagagccaaaaaaattaattgaccccgaaaaagggagaaagtgaaagagattattggagtagtatatcttttcttcttttatgttctttccttcgtatttttcttttggcacacaaatgaaatagtgaaacatgttttttactgaatttacatgcaaataatgaacggattcagaatttaaacgatgtggctataagattgagagagttaatttcgacatgcacatctaacattatctatacttgtttattgtatatatatacaatcaaaccttttataacagcttaatttgttccggatattttcggatgttataccgaattattattatagaaaacgtatattataatagaacatgagatttagttccgaaaatatttgacttttataaaaaagtgttgttataaaaatgatgttgttatataaagagttctgactctatatataaggtacgaccctgaaacactgaacccttgggtctgccaccccttattcttgagagcttccctctctatctctttcgatttatcagaacagatcagactatctatcaatcgatttgaaaatagcacgctatctcgcttttttgcaaaggcaaatcaaccctagcaaaatggagaaagctctttaaaactactcaaacccaagataacactattcaaatgatctactatatatgtaagatctaaaaagattcaatagacagaaatgtaaaggaccagaaatgaatgagaagcaatggcactgccaaaaacaggtgaagacgacgacgacgacagcaacaacaacaactcaatataattccacacgtggggtctgggacgggtagtgtgtgtgcagatcttactcctgccctggagggtaaagaggttatttccaaaagaccctcggctcaaggagatgaaaaggaggtaacaataacaaccactacgtcacgaagacaatgccagcaacctaagaatcataaaaataaatggaaccaaaaacaggccaataaatactttctcagtagagaaacaccattttttggtattaaagatacaacacaaactcaacaactcagaaaaataactagtgccgagttcaacagcattccttgtgtctaagggctgcaatttatttgatgtccttgggttcaagggctgcgatttctttaatgacttgcgctttatcggcctcaaactgctcgtcctctgcagacaagaaaagacgattaaggacgatgaagcaatgctttcaaaagatgcggtctgctccttttattgtgtttcatacctttgtcagtcttaaaatcggcaaagagacgaagtagtttgcttctgttagcaatgaggatgctaacaatatccggaggcttattgtgatttgcggcaaatagctgcaaagcattcaaaggtcagacacaaagcatttgacaatggaggtaacgatcgaatatataaaagaatgctaaaaccaataggctaccttgaagacatgaaacgcttctatttggatactttgcttgactcctgccaaagaagaatttagcaatcaacatcgggtgataccgataccatttaagaacatttgttaaagactcgctgatgttaggattctcacatcagctgaagtgacgagaaaagagcctaattactttcccatatttgtaaaacctacatacttcatcctgcagcatatctttgttcatatgcacagaaaatgtctatatcatggtttgcaaggtcaactagtaagtgacactccacaccacaggttgtttatttaaacaattaccggtctactactgggtagtcacagataaaatttaggagtggcagtttacaacaacaacaaaaaacccagtgtaatcccacatgtggggtctggggagggtagtggagagggtagtgtgtacgcacaccttacccctacgttgtggaggcagagaggctgtttccgatagaccctcggctaggattggcagtttgaacctgtaatttctgaacctaactgggtatctcaagaagttacgatacagttgtccatactatataatgggcggctttaaagtaaggataatgaatttttttttcccacttctttttcaattttctaatacatcttaaaaacgtcaaaggcgcaacagtttttggcaggtaggattgtaatccaaactcaacctacagacacccaaaagtcaactcataatcaattaatatacatgtggaggtttggctttgattattcttgtcgtaaaccgtgtcaacatgtttaaatttaacccagtactgcattttccacccattgatgcatgtctaaccctaaactagtaacgacagaaagggtatattgagaagcataggaaagcccagaactctggcattgaaggagacacgacgaaagaaagaacaaacaaaagtgatagtaagtaagagtgaaggtgatcaataccctgagtagattcataagaatcctcaagttgtctcttgagctaacataacgtgtcattacagcagaatttgagcggtccaacagcatatctgccaagagctgcaacagtaaagcagacattataaggatttagaaagaagaaacttttaaatgtggcttctttaaagctaaacgtcacaagtatcctgaacatgaaaattgaaagactacagtcaaaatacgtaatgtgcttaaatatctacttatcttgaagaagtagaaacgacattataagatttataaagaagaattttacaacggagcagtgtgcttgaatatgatgtggcacaaagaagcaactattcattttacttctaggtaggaaccaagataagtaaaaatgctatttgaactgcccgaaactgtcttcgaaatcacaggttctgttcccaatcatgaaaacaatctacagaagattccactggcatgtgaaaactcctaacttcctccttattcttcatttttgcattttttatttttctggaataagtcgccaaaatttttattcctctaatagcatagcgaaagtgctaaatatgtatagtaacaaaaagtcataaccgtacttcacaaagtttgcactaatgaaaggatatgagtaaaccatattattttttattttccatattacaccaaaaagccaaaaaagggcaagcatttatatattaagcctatgtcgtggttcagcttttcctccaaaaaatctctgattcctttcatcaaaatataaaccaaaatatcacgacggaacgatattccatatgcttctactgtctttttcactctcccgcctgaccagcatgagagagcgttctttacaacattggcatatcccagttccatccacaaagatttagaaataaacttcacaacattgccaccacaccatgcagcggcaaataagtaatattcatcatgcctcccaacacaattaacaaaatacaaaactcccttgttttgcaaaatgtttatgtcaatcaagcttcatgagtagccagccagcagaaagcagccaccgttaaaggggctttgctcctaaatataatcttccagagcccttagtttactgcaatcgacaatgataccaccttatagacaaacataacagtaaacattccagcccttcactgtttcacatctggtgtaccttgtatagattaacaccttcctcctatttccttcttaatatgaaaaagaggattccctctcagtactcaacctaaaatgcacattagatatgtattttctaaggaactcataacaaaactgtaaacgaacatccctgagagcagaaaaggtaagaaaagaaaagaaaggaaaagctcttccacaaaatgcagataacattcaagtcaccgaaacatcttgtttgtgtaagatctggaggatttaaggaaagaaatgcaccttttacctcaatgattcataatgtaacataccaagcttacactgagatacttcgcaaaatgtgagagattccaaagaaacaaaactcgtgcccataactatatactattcgacagaatatgtccacatcaagaggggccaaatcccttaccttgacagcttgtcttctagtgatgtagttactggactcaagcagctttgagttatactcggtgaaaaactgaaaccaaaccagaaggcgtataagttaccaaaaaaaattcccagaactactaacaagtcgttcacaagtaacccaaaaggacacaaaaaacagctattacaaatgaaaaaaaatattccctgcaacttctgaacatatctgtgtatcagttcactaactcccactaacgccaataaaacaacggtggttccttttattaactttttttttgggggtggtgggggattttttttttttttggggggggggggggttagggggttcggtctctgataaaacaactgaaagttgaagtagttgatctgaaaatatccttaaccctcaaagatgcaagataattttcagtttcctttggataattacaattgatcttttctgttttcaccccttccctcaacttcaaaaacgtggatgtaatagacaaatggaacaacaagaataaggtccacaatttaggattataatactattgccaacgggataatacattgccatgaaacactcaagagcaaaaaagatgactttacaatcatgtaatcttaacaaagaacttaatagtgtaagcagaactagtactgaagaagtagcttgcaagcattatgtatatatgtgaaaataaagtcacaagcagcataattcctcggaaaaaaaaaaattgcctgcacacgttcaatagaaacacttctcaaaataattctctttcattacccagtcataattctttgaaagaaattcagctactgttgatttgtgccttgtcaagagttcctgacaagaaatataagccaatcaggataatgccgaatagctcattcatgataacttagtccctatggaacagcaaaactataactttccaaagccattttgtccctatgcatttacttcttaaatattttctaattttaagtagcaaaatgacttcgctttctgctttttctcccaacttaatgaggcagtgataaggcaaaggagaagcagacagacaggttgtttgctttatagtcaatataaattgattaaacaatgcaaatggtcaccactataatgacaatgacaataatgaaaacaggattatctatacgatattcattccagattcttgatcaagagcattcaaccttaaaagtggcagcagcatcagcagcaatgtcaaaatttggcagctgaatataattgaaaaacttcttcatatgctgagactccaagacatatctaaaaacaaaagaataaatgtaagttctcagcaaaaaagagccatacaatagcacagagctacttttatgtttctattcaagccttaatcagggactagaaagagattactgaaagaaactaattacttcaacggcaggtcacataaataaatctcctaacaccaacaaaacttaaaaggagcaaagaaataattctagacagttttctaaaagacgaaaaaatccctaaaataggttcatgtggcttactttgcaacactctggtggcgaatgcactcccgcagcattgcaccataatgtaaagccatatctgtattctcataactaaatgacaagggaaaaggatcaataagaagtcagcgaacacataacaaagagattagcaacaggaatcctcacaaacatcctttgcacccacaaaataacttcctagaagctctccgacatcaaatgcttgcaaaaaggcagcggaaaaatactaccaaaatgggataaaatttggctagccatgcagatgacattgtaaacatccagaaaatacttacaattggactcataaataaaattaaggtctgtgctaaaattaatatctgaatttaatttttgaattttgccattgcgtagagccgatatttctattggaccagaaaagggaagtgtttcaaatgaaagaagatcatgcagacaagggttagaaacacacaaaatactgaatgaaaataaaggaatacaagaaccttgtttttaaatcagtataaggaacacaagaacttctaggccaaaagtctatggatacaaaaagatttcttttatttaaataatctgacctagctttcgcatggatacagattagaaaccagtggcagaaaagtaaatgcaaaaacttaaagaatatggaaaactaataaacaagaagcatttgacaatgtaggagtacaaagccaccacattttgagcatgttgtcgctgtagcttaccctaatattaatatgtccatcaaatcaatgtttgcttccaagtaatcacaagcaatcagccgtgactgaacctgctgtctctgcagatttgctactacttgagtagcatctttgcgggtctgtgaaatagaaacatcattttattatagaaaaataaggagcagacaaaaacaagatgtcaaaagagtaacaggcttaacagaagtgaaaacccaattcaaattgatcaaataacatgtagtagaatcaccttaaaagttagagaaactagagaacaacacacactctcgaaatgcaaaaagaaaaccatacataagatccagctgacatgacaagaaggagattatctgaccataagcaactttctgaactcacagaagacttcaaattacctctaaattcaaattgggaagacaagtaattatcagccggagtgtgttctctctgaagaattcttgagtcaactgagcgcaggcctcagcgagaggctcggattcaccattcccgtaaagaataatctttaattcccggattgacttgcttaactccatcatctgcagatatgcggttaagaagaaaaagtgtataacaaacactatactaaacataatcaagcaaaagcataactcatacaaaagtgtactgccatatatctatctcaaatcataacgggcattgtcactgatgattcaacacgcaactccagatcacatatttgagaaatcacttgagttcagtcaccaattctactgcatatcacataaaactcttatccaccgcttccattgttcacttagcaattggtgttatcaacaaatccacagaattaaaaaataaattttgataacaagaaaatgaaccagatccaaattgggtttagtaaagctatcccaattgtgaaaatttcacaaagcaagctaattcaaacaattgaatcaaaccaatcaactatgaatcccttgtatccgttccacaatcaactatgaatccctctgtccgttccactctattcaaatcactaattcataagctaagctaattcaaaagtctcaccccaacaatcaatcaatcatcaactattccacaattcccaaactagttaggacagaaaacataaatccttatatatttcactctgttcgagtcccatttttcttccgatagaagataagaaaggtaacatttttcagtaagaattaattaactgcatctcaaatcaaactagttgagctcagctatatgaatcctctatacccattccactccatagtccactcacatcactaatccgcaactaagccaattcaaaagtatcagcctaaaaatcaatcaatcacgtcaactatgcctcaattccaaactagttatcttgccctttttgtttttttcaaaaataagaataagcatcaacctattcaggtcattaattcacaaactaagccaattcaaaaatctcaacccaacaatcaggcaatcatcaactagacctcaattccaaactagtttgaatcgaagatacaaataactatatattatgctctattggggtccatttttctcccaatacaagacacgataatgcaacaaacaatcaatcaatcatcaactacgcctcaattccaaactagccaggatcccctatagatttcattctattggagtcccacttttctcccaatacaagaggttgagacaagaaaagcaaacattttttgttggcaaaaataagaataacggtcaaaccttttcatcaactatacctcaattccaaactagcgaaaattaaagatacatatttcactctattggaggtccatttttctctcaaaaaataaagatcaaaccttttatcaactacccccaattctaaactaggtaggatcaacaatataaatcccgccatatctcactctattggagtcccattttctcccattacaagacattgagaaaagaaaaactaattctctttttctgggcaaaaataagaataaagatcaaaccttttcatcaactacgcctaaattccaaactagtgagaatcaaagattcaaatacctatatatttcactctatcgggtcccagttttctcctaatacaagacattaacacaagaaaagccaacattaatttagcaaaaataagaataaagatcaaaccttttcatcttttttggtctcgcgagtatctgcagcacgctcaaggaacataagaagatcacgagtctgacgaacaaggtcaactggagtctttggtttagacttgaataacccttcatctttgcatcaccagcagcactaaagctattctccctaaacgacgtcgctgaaacagctgcagttgttggaattggaataggagacgagagcctctgaaccacaactgattgtggttccgaggctctgccccctttccctcctgatgataaacaacctcctattttgcctttagttttacaccaaaaacactgtaccaattacagtttgaattctgttacagttcttcaatggggttctctttttacatttattttatttggagggggccaagattttgtgtattttttatggggtttgatttggagaacacaataacaatttgatctttgatttgatctatgatggggttcaggtgagtagttcaaattggtgtcgacaagtatttgttgttttctcctatggctaaattcctattcctaattatactcttcctcttttcattttttttttttctttttctaccaaaatatcacctatataagttgtaatttttaccttttagttttttcttaaatatttaatattcgaaattaatgatccgataaatctgaattcatggatagggattaacaagtaaaaatagcacgggctagccagttttcgaacgagtcatttaaaaataaacagtatttgcaaagtcattgaaaaatagccactattttgcttgcaacatggaaagttccagtataatatactggaaatcggtacacctgcgtagaactttcagcatattatggtggaactccaacacgcagaaagttccattataatatactagagattggaacatcggtatattatgtttgaccgatatattatactggagtatatttcaaattttgaatagtgttttcgttcagatttatctttacatgaaaagtggctaattttctactacttttgaaactgtggatatttttaaatgaccacctgaaaatcttgctatttttgaatttctcccacctaacaaaggaaaaatactccctatttagaatttatctattctcaaaacttaattcggaacttcgagttaaagtttgatgcattcatcatattaaattggttaacttttagttctcattataattttttatatgttttcttttatctaaaatacaagtatattattgaaatattgtgtatttaataaaaatattttgattagagaataaagttggaaaattatacaagttaataaaacaaaaaaattggttatatcctatttaatttaggaaactactagtttattgaaactctataataattaaaaaaaagaatgtactattatattttttagtgatcaaggcaaataatcaaagaataccaattactattactttcaaccagctttgtgccatgaacactagttagaaaacttaactctaaaatttagtatttatcggataaaaataaagagaagaaaatgggaaaagtttattagatagaagaagtatagagcttataagttaagggattctttttagctttacattgaaaaatttacaaaaaagaattgtgtatacgggtgaaatagagctcatagtgcatgccgaccccgacaaaataagccaggttcgagacatggcggcaagggacaaaaatcggatcaaagtcccacaaaccagaattcggaggcatgacgcatttccacgagaatatcgaggccaagattccggaatcggtcttgacctcgaaggacttcgaagaatattgtcagacaatccaacatagccaacagaaagccaaaatatatgtggccgcccaaatatcatggatagagtcttcacatatcgataaggaaccgacaagtaatgatcatgatcagaagatttttcaccttttatagagttacctaaaataggaccctactactatataaaaagagtctgatagctcataaagtacattgtaacacgcgcggaaaagcaatatattattattttctctttctttagctcttgttcttttcaacagtttaccggtcgtggcgagcccggctcgagagtagttatttcaacaaggctgaaaccattcaattcgtatggttcaaatttattttatctttatttattcaatagtaatttaatttatcgctttgtattaaattaattcacgtatcattaaaattacttacaaatttatttattattcgattttgagggtaactaaatgcctaaagaattgttagtcaaaccttttattattgtttatcaattgtagtatcaatcatcatactatataatttctataagtcgttttccataaatcaaccatgtcaagtcatgccttaaagaagccacgtcgctgcaattatgattctttaaaattaaaatcatatatattcgagtatttaattgcctacaaaaaggtttattctttggtagcttcctatttttcttatattaatatttgttatttaatcttagttaagtaatatgtatttgtttttatttcttttattcaattttacgtgacactctttcctttttagtatattaaaaaatgcataattctatagttagaattagtttaactttaaacttctcattttatccttaaataatatatttttgtgactaaaaatgctcaagaccacaaatttttgaaatttttctttcattttaaaactcttttcagtcatacagtgccacatataacatcgggcagaaagtaaaattctaaaagtacattgtttggtttaaatatcaaatgcagggccatacatctcaaaaagcaaagtagccacagtttcaaaagtaatcgaaatttaacccttttttatgtaaagataaatttgaacaaaaacagtattcaaaatccggaaaatactctagcataatatactggaattccagtataatatcctggaattccagtatatatactgaagtttcaggtatgtatactggtctagcataatatgctggaagttcatacacaggtgctcgaatctccagtatattatgttggaacttttcgcgtgttggagttccagcataatatgttagaagttcatacacaggtgcaccgaactccattatattatgttggaccggtctatgttgcagtaaaatagtgactatttttcaatgagttggcaaagtaaaaattgcgcggggtgctctatttggtcgcccccatttaacctatacccatatttttaaaattatttaacttatgccctaatttttacaacttcaggcgccgccttcctgatacctgtgcaaaacttcagtttatttagtgctgaagtttttacaaatgaactaaataacttcagcattttctgctgaagtttttgaaaaagctttttatttcaaaactaatgaatccaggacaaaacttcagcttatctagtgctgaatttttacaaattgaactaaataacttcagcattttctactgaagtttttgaaaacgaactaaatgacttcagcatcttatgctgaagtttttgaaaaagctttatgacaaaactaattaatccaggacaaaacttcagcttatttagtgctgaagtttttacaaatgaactaaataacttcaacatcttttgctgaagttattgaaaaagctttatgacaaaaccaattaatccaggacaaaacttcaccatatttagtgctgaagtttttacaaatgaactaaataacttcagcatcttctgctgaagttattgaaaaagctttatgataaaaccaattaatccagaacaaaacttcagcttatttagtgctgaagtttttacaaatgaactaaaaaacttcagcaattctactgaagtttttgaaaaaacctagaatgctgaagttttgtgtgattgtctttgctacttcaggcccgtatgcctgaagtttatgcaaaaagtgggtaaaattgcaagcgggtataagttaaaacgttacccaaaaatcgggtatgggcgcaaatcccccattggcaaatgctaactatttttgaatgaacagtccgaaaactggctggcccgtgaaatagcgaatgcggtaaagtattttccgttcaattaattgggttgacaatcaagtgtcaacttggggttgtattccgttttaattgttatttgaccaattttataagatcattaaccattaattaccaaatcatggcgggagagagacttggtcttaatacgaaaagttgcttaagaatatgcttaatcgctgaattaaaaaaaagaatattctcaaaagtttagcagttagaagaaaagaaaatttcctttaatcttcaaagaaaattacaattatttaaacaagcttcgtttagcgacaaaatctatcattcaagtgaaaataatatttgaaaattagagttatgtttggacataaatacaatctggaattgtttttgaagttttgtaagtgatttagattaaaatttttgaataacaactttttggagcttttcaaatttctaaaaaattccgaaattcataaatttccggaaaaagttttttttaaggctaaacgggcccttattttcatttttgggtttatgaattgaattcagtcagactcgacattattagagtgaggctttagttactagcaaatggttaatataaacttcaaaaaagtttttgcatcaattttcaacttttctcggattaccattttagaaaaatcatttttcttatttatttctaataatgtgattgtattaatgctataattgttatttgccatgtcacacatggaattttctttttcactctacaaaatggaaatgtggggatatccaatataaaatgtccttttaatggaaaaacagttgtgtctattcccaccattgctttacatgaattttatgtatcctttttttttctttcttcctatagtgagttgaagcatataatattgagaggtgtagtgaattaaaatggtaagattccttcacatttaattagaatttttgatcctttttcggataaaaatgcataataatatttgataacgtgaatctaaattagtcgaaccgataaatttcgaatagaaaatcatatggagttgttggtgcacttgcaacattggatagaaccaattagacaaaatacctttccacattgattggggtgggcatatttcggtcggaaccgaataaatcgactgaatcgaaaaaaaaattatttcggtttcggttattcagtttgttcggtcggtttcagtttaaaattttaaaatttcagtttttcggttcggttttcggttattaagtaatttagttcgattaaccgaaaacccgaattattacactatgtttgaattttatgatccataatagtgtcaaagtttagtcttttttttttaataaacacaatatttctaacaatgtcaaagttttggaaaaaaataacaaattcaccggtcctattattacatagaaggatcccgatatgataatgttcaaaccgaaaaccgaaccgaaataaccgaaccaaaattagaaaaaccgaactaaaccgaacttattcagttcggtttcggttactacttttacaaaaccaaaaaccgaataaccgaaccgaatttcttcaaaccgaaccgaaccgaccgaatgcccacccctacaccttgaaggtcacatgcacaatctatatagcttggccactcatttttggccttacctatctccaaacacatcaagattttcttttttccatttattgtcgctaaattcgaaattaaaaagaatgaggtccctgacttttcaactaaattagcaagaaaagtcatagatttattattttattacattgccatttggctacgaacttttctagtgaggatatactttgggttctttgtaatgccattgttaacctctttgaaatacagtcaaatttttctataataatctttgtttgttccgaatatttttgaatattataacgaagtgttattatagaaaacatatattatagcataacataacataaaaatggttctgacaaaacgtggcttttatagtgaaatgttgttatatgaaaatgctattataaagagttttgactgtattgactttactttaaattttagatggaataaatttaactgcattgaagttaatatgccgaattaatgaatacaatgcatatgtcttactcttacatataaactaaggaaaattacatagtttatccatccatcttgcacccaaatccctattacacacatgttgactacgggtttaattttacacaccaaacatttcaaatgtgtgtcaattacacactacttttgattaacctagttaatattcaatgttgtgcatacacactcttatttaaattaaaaaataaatgattctttaattaaaaatggacaacccgatccttttttaatcccgacccaaaaaaatcttacccggtcgattaaatacaacccctcgaccagattaacacacataattgcttaccaaccaaaatgttcttcagccctagcctttgaaggcgactccgacgagaacacatttggtgtttgttgctatgactttcgtcatttttaggttagtattctcattttatggtgttcaattgttttgatttagatgggtggatcgaaatagttagagtttgtttggctatttcgtcgagagtatttttagggctttaagacatctttatgggaatctcttgtcattgtctactgaaacctttggcttttgagcttgtgttgtcttcttctttctttattgtgttatatctttctttattgtccattttgatttctttattctttgtttacatgtgaaattgaaaccagttgtctgcttgttttagggacaatgtcttttgaaattgttactttaaagtggtatcagaaggtgagttaattattggcccttttagtagatatgtggagggcagtcaatcattgactttgacgtggatgtagatataatttcattctttaagcttatggattacactaaggagaagggactaattaacgtggttgagctgtatatatgcccgatggataagattgacaaactggtaaatgtattaactgataaggacttttagacatttgcaatcagttagaggctggggatacactagaaatatatgtgactcatgctgcccatttgtcagtacatggccctattggaaaagggaaggtgcgagtagtagttaaggcttctggaaaaaggcatatagagggcgaagaggttgaaggggtagatgatgaaaattctgatgacataccagtgacttcagacaattttgctatttctgatggaaatgtttttgatgatgctgcttctaatgatgctacttatgatgcttgggaaggaaggagaagtagacatggactgaacttttgatagttctgatgaagttgacttgaatgaaggagaagtagacacacgttctgatgacaatgatctccaatctgatatacatgaggagttgggtaaggtagagaggaggtgaagagaagcagaagaaaaaaatctgaaaagcctaaagggaggggtaatataaacatagataaagcaggtgtagacactaggcttgatgagctgtgtacaagtaataagcaaaataggtatgaaggctagttgggactgatgagccatattttggttcttcagatactgaaagctttacttcagatgtggaaggtgaagatggtgaagaatataaaaggaaaatggaggaaaaaaggaaaaagaagagattgatctttgatcctactgccaagaaaataacttgggagttaggattgatatttgaaaatgttgatgagtttagggaagcagtcacaaacattgtaattcaaaaaaggtgcagattgagaagtacataaatgagcacatagggtgagggttaaatgcatgtacctaaatgtggatggcttctagcagctagtaaagatggcagatccaataattttaaggtgaaaaaatataatcagtgcacaagtgttatacaaccaacaagaacaagttgtgtaattcaagatatcttgcaaaaagatacaagagcaaattatatcacaaccaggtatgaagtttgggagttgagaaaattgataaagcaagaactggacctctatgtagggagatcaactgcccataggctagagctaagatattgaaagaaatcattagtgatgtgcatcaagagttcaaaagactctatgactacagagatatattttgcagaccaacctaggagtacatgtgtggtaaaagcagaagatcaagtgatggaaaacttgtattttctaaaatctagttttttacatgccatgaaaagggctggctggaaggatgtagaagaattattggccttgatggatgtttcttgaaaggagtttgcagggacaacttcttgtagctttctccaaaaatggaaacaatcagatgtttccaattgcatgggcagttgtagaattggagaacacattcaattggacttgatttttgaagtgtttgagtgaagatttgggcttagaagatggtaaagaccttacaattatgtgtatatgcagaaggtaatatttttcttcagtaactattttccttcattaactattttcagacaataactattttcagtcattaggcttattcagtgcttaatagtaattattctgcttcagtaactatttttttttttgaatgcttcagggttaattaatgctgtaaggggattgttgcatgagtatgaacacaaaatgtgtgctatgcacatccttgcaaattggtcaaaagagttgagaggattggagagtagaaaatactttctggagatgtgcaagagcatctagtatttcagaattgaatgaacaacttgatatgctaaacaagcttgggagggcatatgtgaaagcttactccactacagaaaagaaacctggtgcagagcttatttcaattgtgataagaagtgtgatattattgacaacaatatgtgtgaaactttcaattcctgaattttggctaagagacacaagacaatcatcataatgttagaggaaatcagaattaagctgatgattaggataggtaagatgatggagttatgtgagacatggatatgtgatatctccccaatagcaatgaaggtttaccaggatactttagcaaagtctatgaagtatactccaagatggaacggtgaaacatgctatgagattgaagatcctaaatacaagcatgtggtatccttagtgaatatgactgtagttgcagagcttggtagttaaaaggtattccctgttgtcatgcaattgctaacatacatttcaaggacatggaacctattcaccatattgcacattgatatcgtaagtccacttacttgaaggcttattcaacttttatccagcctgtgccgtgtatgaaatagtggccatcttcaggccacctccctattgaacctccccctattagaaagatgcccgacagaccaaaaaaataggaaaaaagaagaaactgaacatccaaaatctataaagctttcaaggagagatatggagatgacttccatcagtggtgtgtgtggacacaacaagaggggatgcccagtaaaaaaactgttgctggaaatgctgtaccaactagtacaccttcatttgctgctggaagggtagaggaataggaagaggaagagaaactagtacaaccaccacatctagttcacaatcagcaagaggtagaggagtttctgcaagaggtagaggcagtgaaattgggttgtttcaagcaaggaatgggttcactttttttactgtaagtgaactaattaaagctataattagtgtatcttatttatattgaatgtgatgttgtaactaagtatactgtactttggcagaatggaggacaaaatccaagggtcattagcacctgaactaagcctaagaggtctacagcttcaggggaggaatgtgcttaccaaccaagaagtgtcggcttgaggtggatgggcaaaaaagccataagcacaagacaacttcaaagagctgcaacatcacaacacaaacttagtcaagctagttcataatctcaaccaacgaagaagcagaaaaaatgaagactgtggttgtagtttaagctttatgttttgttaagtgttgctatggacaataatgtattctgttttgtaaagtgtttctatggacaaccaagtgctatttttgttttgtaaagtgttgctatggacaaccaagtgctatgttttgtaaagtgttgctatggtcaaccaagtgctatattttgtacagtgttgctaatccgttctagtgtctactaatgaacacctattttgtggaatgaagtatatttaggtcttttttttatactggtatactttggttatacaaaagctgcattatccatgtttggttaccaaagctaaataggaacataacacaagagaagaccaacaacttcaatgagctaaataggaatatgacacagagcttgaatacaacaacaacttcaacaacttcaatcagccaaatacatgaacacccgagacaggggaatatcattacactatatagtagtgctcggaactaccaaatacaatggccttaatgatgattaatcctaaaatcagaaaaataagtctcctctgattcctctgttttttgtattcctacaaatgccattcaaactgcttctcttcctaagcaaacccaaaatcacttgcttcaagtgttcatgagtcgggtgatcaaaccatacgaaatacttacacccagttttcttatctttctgcaaatcataaacaatttgaaatgaagcttataaaatcttgaaataacgattataacaatctaagattacctcattatttttacagttgtagaatcgacgaccatggttgtatgtactccatgaaattactagttcagttgcatctccacatcgacaaaatggacccgaattctccattcaatatgaaccctaatacgagaattgactgacgaataattatcttaccttgtgtattgtactttaattgaacaaatataacgagtttcaaaatattagatgtgaaagatgaagatgggggggttgagtttttctgaaattggttccttttaatatgaaaagatgaaaatggttgcttttaataagaagaagatgaagaagtgggcgttagggttaggaaaatgggcacaattccagtaattagccgttgtaattagtcaggtgaggcagaaataacttttcacacgccgcattggtcgtgtttcacacttccgagaggctggtcaaaagtagcatgtaattgacatacatttgaaaggtttggtgtgtaagttaaacccgtgatcaacagatgtgtaacagggatttgggtgcaggtggatgggtatactatgtattttgcctataaactattaataattaatcatcatggttaagtgatatgaattttaactttaatttacaactgttataataaatccttaatttagtgcaaaatcacgcataagtacttttctaccggacattagaacaatttccgctattattctacatctattttttctttttttttggagagacataaatcttgaatttgtaagctcactattcaattccaatttttatttgtaatagcagtaggttataccgctccctataaaataactttaaatataatttttgactattaaatggtgcaactatatatccaatctgattattcacgagaattttagcactagtatttaaatatttgactgccaaattataatttcgtttcaaatctgatactccatgtcgtctcttgaaagctaacaattttaaggcttgcttgagcaagattgtttaaaaaattagctgtgagggatccccttagaatatgcgcaaaacttcaaattaaactattattttatcattctccttcactttcaatcacgacaatgaaattaacctttgatccaagaatttcgcatacaaggacaaggaattaatataagaataggataaaaagacagcccagtgcactaagctttcgctatacgcagtccgaagaagggctggagcataagaatctaatgtatggagagaaattaaaaaaacagtcagatttacaagtgggcattcaaaaatagccatattttcaaaagtaatcgaaatttagtcacttatcatcaaagataaatctgaacgaaaacactgttcaaaatccggaaaatactccagcatagtatactcgaattccagcataagtatactagaactccggtataatatactggagttcctgcataattatgctggaactctagcatattatattggagtttcagcataagtataccggatctccagtataatatactggagttccagcataatatattggtccagcataatatgttggaagttcatatgcaggtgctccaatgtccagtatattatgttggaactttccgcgtgttggagttctagcataatatatatcatacacaagtgcaccgatctccagtatattatgtcggaactttccatgttgtatcaaaataatggctattttcaatgactttgcaaacgctgactatttttgattgaccaatccgaaaactgcctagaccgtgctattatcctcaatttctgcaagaggttgtttccatagctcgaacccgcaagaggactgaagaacgagtgagtcttgttttagggtttatgcccattaccgatcatgtggtcagtttccccactttcacgacctcctgatcacatgacaataactttaccagttacgccaatgctccccttcaatataagaatatggtgaatatagaaatatacacattgtttattaacttttttttcctaggtctatattcaggaaaccacgaggagaagactttcaaggcttgatctattatactattatcctagaaagtcgagcctatatatctttaaattctttgtatttaggcatcttaatttcgtctaatctcacttcaaaagttcaattttcgtatgctagctatatttttaacgttccatagatcaagctctcgacacccttagttccatggattagcacaatatcatcttcgaagggatacaccgcgaagatgatattgttgacatcccatatatatatacatatagtagatgaggaaaggtctatatacgggcccaacattgtaatcttaaaattattatttgtcggttttcaattaattttttgataaataaattgattcttgttatattcatttaatcacagataaagaatgatattgtggatcacaatttatgattagtttattttaataatttacttaaaattaaattataaattataatctatttaagttgttccatttttaacattcatatcaaacgtaaacatcaaattgaaaatttatttgaatggtattattttcccaatgtatttgaataatttacaagagaatatattaaaactacaagtgccatctatattaacaacttttctataataaggctgcgcacgttagagtgcatgtactaacatacgccattagccatgggaaggggaaggccgaagagaattgttcctacgattgctgcaatgggaagatttagtgacgaagactccaattcagaagactggtatcaagttgggtggtgatcatggcaaaagtccaaatggaacagtggctgccattgatgactatgaaggatgcgggtaaaactccattgatgaggatcgaacaagctaatatagtcaatacggaagctccgatgaacatacaactcctaataagtggaaatggtacaattgagacgaataagcgagcaattacagaggaaatggaaatgaaggagaagcaaggaaaacaactccactagctactgatgcagatgataaaggtcagaaacagtggacaaacctatttgtaggctcaacttatgcaacaaaaggtatggatctgagctatattgcacctattaccaaaaatggcgaggttagagtagaactgtgtaaggaagagattgaagtggaaactcagaaatggaaattagctctaattttgtacgttgttggtggtagtccaacaataggtgcaatggagagatacatagcttcggtttggaactttgtatccaaacctaaggtctattttcataatgatgggtacttcgtggttagattcaattcaataaaggatcgagatgaggttctatactcaggacctcatatgttgaataacaaaccaattattgtcaaagtgtggtcgggtgattttgattttaacaaagaggtactacagaccatagcagtgtgggtaaagtatccaaatttgccactgaattattggggtaatagagcattaagcagaataagtagtggattaggagttccattatatgctgatacctgtactactcaggttgatagggtctcatatgcaagggtgttagtggaaatggatgtgactaaggagctgcctaaatcaatcaaagtgactgatcctaatggaagggagtttgtccaagaagtagcttatgatttggtgtctgagttctgtattaaatgcatgcaggttggtcatcaatgtagaatggtggaacaacctaagatgaggaataagagtactaagcagaagcaggagtggcaaccaaaggtgatacctaaagcaaaggaaccagttgtgatggaacaatcacaaggaagagtgattagcaatgaaaagaatgttagttcaaatgcaagtatatcaggaattgaggaacaaaagtggcaaactgttatagggaaatcagcagcaagaagtagagatagacaataagtggatgtcctgaatgtgataaatggattcaatctacttgcagagtctaagatgcagatagaactaccaagccaggttggagagggaactagtagacagctaggtgatgcagggcaggaaggggctactcaaactctgtttataccagtatgaagctaatcacatgaaacataagaggtttaaataaagcctttagacagaaggagataaagtggtttcttagcagtaataaggtgtatataatagcattattggaacacaaaatcaaaaaacagaaggcagattaagtcactaagaaaattgctcctggttggacatacttagataactatgatcatagtagcaaaagaagaatatggttattgtgggatccaagtgaaatagactgtacagaagttagtaaaactgatcaaacagttcatactactgtatatgttagaagaatggaaatgaagttcaattttacagtagtgtatgggctgcatagtgtggagaattggaaaagtatgtggaatgaattgataaggctacattcagtgcaataaaggccctggttgattatgggagactacaatgcagtaagaactattaaagatagacctgtgggtaaccctgtacaagaaatggaggttagagacgtcattgagtttatggataacactggattggctgaattgaaatcaagtggtagaaattttacatggaccaattggcacacatatagcaggatagatagagcaattgttaatgattgttggatgttgttaatgccacagatggaggtgtggattatggatccttattgttcagatcactatccattgagtataacacttgatgaaactgatgaaaagagttcaaaaccttttaaattcctaaatcatttatctgagcatgagaacttttttaagattgttgctgaagcttaggaaaaatcatatgaaaaacacactatgaggaatgtttggaagaaactgaaaagagtaaaataggctatgaaagaactgaataagaatgagtatcatgctgtgggggataaaatcaaaggatgcaaacaaaagttaatagaaacgcggaacatatgagggatccaggacaaagtatgcacctagtagaggaggaaagagaggtgaaagttcaactggacaaatggataaggatagaggagagcattatgaagcagaaatcaagagtaaaatggctacaactaagagatacaaacacgacatatttttttgccagtatgaaaagcagatgtagtcaaaataaaattagaagattacttaagaatgatggtagtatagttaggatatagaagatgaggtgacatagttctatcagcacttgctaggaacctcagctagtgagttgcctgctgttaatccaacaattatgaaagatggtcctaaagtgaatagagtacagcagctacaactcatagcagaggtttcaaaagaagagatatatcaagctttgaaaggtattagtgataataaatcccagggggtgatggcttcaatgccttattctttaagaaggcctgaccagtggtaggtgatgctatcacagatgcagttctggagttctttgcagaattaagaatgtttcaccctattaatgttacaacagtcactctcattcctaaggtgaaaagctcttccaagattgctgagtatagacctatttcatgttgcaccataatgtacaaaattatatcaaagattctaactagcaggttgcaagaagtaatggatggtttggtggataaaagccagtctgcatttgtccctggtagactgattaatgacaacataatcctaagccatgaactagtaaagggatatggcagaaaggggtatctcctgatgtatgatgaagatagatataaaaaaagcttatgactctgtagagtgggattatttagaacaagtgctaacacagctacaaataccagtcagtggattatgaaatgtattacaacagtttcttattctattttgatcaatgaccgcctacaaaaccattcaaagcattacttcatgtattgtatacaacaaaatcaaaagaaattcttcgtacaataaataaagagaattttcaaggggacttgcaccctaaaagactatttactacttcaaacaaagaaaatcaaagacactaaacaaatattaacatgatataaattgtagtaattcaatatagtagtttaaattatatcttactacagctcgtttaaaatgatgttaactggtgataaaatattaaacatttgatagaagctatataaattattatagggattaaatttatttatttttgttaattaaggagataagagaaatgtttttatttttatagatttatcatatgtttattttcataatgaaacaatataaaaattaaaaaaaaataatgtttaggataatttattgatagttaaaaatttatcagggaagaatgagctcaattcatgtagattaaattttcatatcaattaagcatataagagatagcccctaatacaatatgaacaaatctcatcacttaaattaacttttgagatttaataaactataatttttaaaattacttttgaatatgaaattttctaatttgaaaatcgccttcaaatagtgtggctatatgaaaatcttttaattttaatttttaaattgctttaaaacagtatgggtaaatacgaaaatcttataaatatttaccaatatatctttttgttgcactatcatttaaaaattaagatatactttctctgtgaaaacttctagttgacaaaatcaaaattaataattttaccaaataagaaaatgaacgttataaataattatttgcatgcaatattatcagtaaaaataatctaatcaatatggagtaacatttaaatgaatattgtgattatggaattataagtctcacgtgtaccaatgatagtttatatttaagaatagcagacaatgtaaaagtttttcttgaaatatatatatatatatatatatatatatatatatatatatcgagtcaataatagtgttcaagtgactcaaatgtcgatctagtaaactatactccaaattgaatattttgtccaaaacgaccttagataaacaatttcaacggcaaagaaacaaacaccaaatctttacttttattataagtcttcaaatgttacacataaagaaacaactaaccctacatacaccaacatcatatattctcattttttccttcattaaaaaaagatacggatctaagacgagttctctaaacataattcaactatatagaaatacaaaaaaaatatgaaaatatatatttgtatttaataagttcacgctcattctgaaaaaacgaatcttatatttttttgaaagaagtaagcttcttaactttctcccaaggcttatcccaaacaacagccaaatatttatgaacagaaccgccgtccttggcgttgataacaagtcgataatttgtgccggcaacgacttgagtttctcctttcgcgatactttgaaattccaattttgtccctgccgctttgttttgctcattcaccgcaaactgccaatcgccaccacatcagggtcatttacgtcagttaaaggcttccaaccacctgctgcgccgcccaacgcggtggagatttggaagaaaaaggaagaaattaacaagattgagagagtcacggagaaaatagaggtcaatttgatggtcattttttatttttgttttttgtattgtgaggattttgagaatgaaaaagctgagaaaaatggttatttttaaaagtggttaaagattttagtgggtgcacttatttaaaggaattaggtggtaggtacgtgaggaaccgacagttgtcatgtgacttgaattccaatatttgcagttgcactttcacgaaagttctaaattggtgttatgggcaaggggcggaactaggtggacagaagatgtttagccgaatcgtgtgtatatgtatatttaattacttgcttctatcactggttatgagaagtgtgactctcaaaacttgccacaaataatatttagtaacggtagttatattggtaaaaaataaatattacacgtaaaatatattagatgacaaagcaagttacgtagagtaatgaagaagcgacagatgcatgagagtttagtaagaggcacggaataaagaggtacgggataaaacacctacgagatgattagtagcaagagctctgatctaattgaggagttgaagagacacggacaaaatgaatcagggctgaataaagggtagattcataaatcttcaatcaatgagttaaacgttacagaatcttcacgcaatagttacgattacctattgtaacgtttcattaatgatataaatattcattaatgctcaatcataaagaagagtagaggttatattaagaaattccctataaaagggaataagatcccatttgtattgacacgttcgaaccattgctgaaatatactttacattcttgtgctcttactatcttcctatttttaaagtcttatttccattattgttttagttaattctcttgattatcagaagtccgagtacttcttaaaataacaatgactaagaatccgattctttggttaaacaaattggttttcgttaccgggaatctaataattcttttctgcattcctgaattatctttactgaatcatgtcgaacaccaactacaacaaccaacacgcaaatggaactccaactccatcgcctcagggaaccctacgaagttcaaggaaacaatcccggaaagatccataactcacaacaatgaccagcttggaaatgaataaacataagagctagatactgcgaagcaaatagttgctgagtatgtgaatgaagctctccaggctttgtgaggggactactaactataccaccaatgcctcctccaaacaatacggcaactgtggaaaatccacaatctggactagctaattccggaagtagaggccctccaaacgaatccgtcgaagggagaccaggtatggctagtaattcagatttacaatctttaatactaatcttgcagaaagaggcgaaggaacaaaataaggacggggagagggaggctctcgaaaccaaacgagactagaaagaacatgggaattagcaccattcatatgagtgtttttgtctcgaagatcgtatcgagcaattcctgacgtgccagctgtcatcaaagggattgatattgacaaatattctcaaaccatggaagccaagttccgtacctttgttgatcccaacaaatttaaaatgcccgatataccaaaatatgacgggacaactgacccacgtgaccatgtcactgcattcactacgggaataaaaggcaacgacttaaccaagtaagaaatcgagtccgtgctggtcaaaaagtttggagagacgcttaccaaaggagcactaatatggtatttctcttacccgaaaattctatcgactcttttgttgagcttgcagattcgtttataaaagcacatttcggtgcacaaaaagtgaagaaaagaatggaggaccatattcaaagtaatacagggagatacatagttgcttcgtgaattcgtagacaagtttcttcgggaaaggatgcagttaccaagagtacctgataactaggcagctatggcatttgcgagcaatctgaacgaaaaaagctctgaagctacgaggagactcaaagaaagtctgtgagaattaccaaccacgatgtggaatgatgtttataacaggtacagaaccaaattacgaattgaagaggataccatagctcaatcaaacgcagaagacaggacaagttctaggccctcagaatcagagaggaggactggcaaaaataggtacgagccatatatgggaccttcgggatgagaagctcgttccaagttcgaaaacacacggcctgatcacagaccgtcaaatagatattcaagttcatcatcatcaagactcagaaaggatcgagatgaacgaaatagaggcaataacagaaatgcaagaattggagactataacttcaatgtaagtacttccgagttaattacagtattgagaaatatgggtgataaagttcgatgtcccaaagaaatgaggtcaaatccaaacagaaggaacccagacttttggtgtgaattccacaatgatcacgcggcacagaacatcagactgcaggttactgcaaggtgaggtagacttattaaacaaggctactaacagaattgtttagtgaaaaaggcaagcaggcatatatgaagaatagacaggagccccaaaaccaccatctccgaagagaacagtaaatgtgataaacggaggagaaaagttaatggcgtgacctataccgcagcaaaaagatgacgaagttcacaataacccacgggaaacggactcgtgaaactttggaggccgatggcataacatttgacgttgcaatgctgatgggttattgatcccacataacgatgcgctggtaatatctttacttatacatgacactaacgtgagacgagtattgattgatctaggtagctcggtaaatatcattttactaagagttgtggaggagatgttaatggtagaccgtgtaattctaaaagcacgttcgctgtccggattcgataactcttgtcataacaagggagaaatttgagttgactacttatgcagaaggcattgtcaaagaaacaaaatttcaagttattgatacagatatggcctataatgtaattattggaaggccatggattcatgacatggacgctgtacatctactctaaattaggttatcaagttccttcaaaatggggaattcaacagattcgaggagatcaataaatttgaggaatatcaattcagtggtacatctcgaataaaaaagaagcggaggaagaaccaaaagacgcgggagcaactcagacaaatacgagaacaaatgataaaaatacagtgaatcaaatcaccacggaggctgtaccaaagcatatggacatggacttcaagcccgatgttaaccaagaaccataggagaatgaaaacataaagacaactactgaagagctcgaagctgttccgctgttcgaacataagccggaacagagaatccacataggagtaaggctaaacccgatcagaagaggtaagttaattgaatatctaaaatctaatgcagattgtttttccttgtcccatttagatatgacaggtataccccagaggtgatgacttataaattgaatgaagacccatcattcgtacctgtcaacagaagaaaagaaagcagggatcattcaaaatcaggtgatctatgaagaggtacagaaactcttaaaaatcggttcaatacgcgaggtaaaatatctcaattggttagctaatactgtagtggtacccaaaaagaacggtaaatagagagtttgtgtagattatactgatttaaataaagcatgcccaaaggattcattttctttaccgcacatagatcaaatgattgatgccactgcaggtcatgaattattaagctttctagatgcatattctggttacaatcagataaaaatggattccttagacgaggaaaaaacttctttattccaaacaggggattactgttacaaagttatgccttttggcttgaaaaatgctggagcacgtatcaaggtggtgaccaagatgttccaggaaatcttaggaagataatggaggtatacattgatgacatgctggtaaaatcaacgcaggctaaagaccacttccaacttctttcagctacattcgagatcctccgcaggtaatattgaaactaaatctagagaatgcgcctttggcatcgaatcaggtaaatttttggttttctcgtatcaaatagaggcattgaagtaaatcctgctcaaattaaagctattgaagaaatacctgatatactcacgagtaaaaagaggtccaaagattgacaggtaggatcgcagctttaggaagattcatttccagatcttcagagaagagttttaaattcttcttagtactaaagaagcagaatcagttcgaatggaccgaagaatgccagcaagccctcagaaatttgaaggcttacctatcaaaccctcccctattatccaaaccaaaggaaggggaaaggctgtatatctatcttgctgttgcagaagtagttgtaagtacaatcctagtaagggaagacaaaggtaagcaatcttccatttactatgtaagtaaatccctattggatgctgaaactagatacccccatctagaaaaactagctttggctctagtcatggcggctagaaaattgagaccatatttttaatgtcatccaatttctgttgtaacttcatatcctttaagaaatatcctacataaacaggaattatcaggcagattggctaaatgggcaatagaactaagcgaatatgacatcttcatcaacctggacagtaataaagtctcaggtcttagccgattttgtcgcatattttaatgccaatataattcctgaagtagaaaaggaattacaaatttatacaggagctaatccaggaacatggactttatttactaacagttcttctaatgttaaaggagccggtttaggaattgtcttgataccaccttcgggtgaaaagataaggcaagctattaaatgttatcctgtcactaacaatgaagcggagtatgaagctgtcattgcaagacttgaattagcacgagaactctcaatagagcaaatcatgatcaagagtgactctcaactggtggtgaatcagatgcaggggacttacactgctagggaaactcgaatgcaacaatatttggaaaaggcacgacacctagtgaggcaattccagtcatggaagatcgtgcaaatacccagagaagaaaatgcagaagtagatccgttagctaacctcgcatcagttacagatataacgaataaagaaaatgctattgtgatacatttatttcattcaaaaattgactaagaccagaatgatgtaacatttaataatttaaactgggattggagaaatgaaatcgtaaattttttgcagaatggtaccgtgcctgaagataagaaagaagctcaagcacttcgatgaaaagctgcacgatattacctagttcgtgacactttatatcgcaaaatgtttggtggtcctttagcaaggtgcctcggacctaatcaaactgagtatgtgatgaaagaagtacacgaaggacgttacggaaaccgcgcaagtggaaggtctctactcaaaactctaatcagagcagggtattattggcctaagatggaagaagacgctgaaaattttgtagccaaatgcgataaatgtcagcactatgctaataacatgcatcaacccgcagaattattacatccggttatatccccttggccatttatgaagtgggggatggatataataggacctctatcccaagccaaaagaaaggtacgattcttacttgtattaacagattatttttcaaaatgggtagaggcaggtgcttttaaacaggtacgagaaaaggaggtgaaaagtttcatttggaaaaatatcatatgtcgctttggtgtcccaaaggaaatcgtatgtgataatggctcgcagttcttaggctcacaaatcactgaattcttctaaagttggcaaatcaaacgtatcacctcttcaccgtatcaccccgtggctaatggacaagctgagtcaacgaacaagactatcatcaacaatctgaagaaacggttggaaaagtcgaaaggaaaatggcctgaagagctactaggagtattttgggcttatagaactacaataaaaacagccacgggagaaaccccatttgcacttgtgtatggttcagaggccctaataccagtggaaattggggaaccaagtacaagattcacattagcaaaaagagtcaaataacgacgagttgaaaacaaatatggatttacttgaacaaaggagagaagccgctttaattcgcatggcagctcaaaagcaaattatagagcggtattacaacagaaaagctcacctaagatattttaagattgaggactttgttcttaaaaaagtttttcaatcaacaaaggaggctagagcaagaaaattaaacccaaattgggaaggaccctataaagtgcgcggtatcgctggaaaagattcttatgagttggaaaccatggatggtaggatcttatcgaaaagttggaatgctgttcatttaaagaagtattatttctaagcaaaaggagtacccacggtcaggtatcattacatacgattttatttagtacagttaaaattatactaacaattttaaatgataggcaaaaagctaacccataccaaatgatgatattagacttgaatagacacgaggaagtaacttaattcccggtctagggttataacctttatgatggaaatttcaaagggttaagcagtcatcatctaaattataaccttcgagtcccgtatgtttttccttttcaggaaaaggaccacaaagaaggaatagtcaagtgctcgagatttcatacttcaaagctcaaacgcttgggggactatataatatggaaggcaaagaagattatcaaagaagtcaaagctcaagaaagaagacaagcaaagagtcagagctcaagcctaaagatctattttacccaacaaatcaaaagttacgagcgaaatcaaagagccaaagccaaaaatacaaagcctgattcagaaacctacaaaaaacatactcgtaaatataaatgaatgtttgggttaaaggcaaaatttagttacgggttgaaatttttacccttgtatttattcaaatctgttgtaaaagaaaacaattacgaaagagttatagacgtactcgaacacaggtaaagtattatgaaagttcaaataatacaaaaactttcttcaaagcattactcaaaggagcatgggaattcctatctctcttttgtatatttataccattatgaagttgagacgtcttcttcattgtgtgtcgttcataaaaaggccctctttataaatcgtgtttagttcaaaaaggcacgaaaaatcaaaagcatttttatgcaaacacttaagagtaaaacaaaaactcgaaaaacacaagtcaggccaagaattttaaacattgatattatatgacggtagaaactaagtattaacttagttcaaaccgaatttttttatacaaaattgccccgaagttgtcatcggggacttaccaaaaaactttaccccaaataggactggttaaaaccaccaattgtttctccaaagaaaaaaaaataaagggttaacaaacacttccacttttcactggagtgattatcttcatcagcagaagaagcagcttgagatggcaaggttgagcagcaacttcactaggcacgacttcatcacccacgggaacctcaacctcaggtgatgagaaactttgactttgccgagacctttctattgtctccttagttttagcaatttcagcttgtaagtcaaagttttcctggcctacttccgttaatgtatcaagctgggtattcaagtaagcccaacttacatcaacaactgccttgtccttgagagattcataatccttctcccattgataaacttttgctctcaactcatccctttcaaccacaacaacatcatacgaagcttgtaaaggggcaagggatctctccagaaattggaccttgctagaggattcacggaggtcttcttgagtttgagtgagcgattgaacgacttctccagcataagcctccttctggtttagcaaatccttaaagcttcttatttcctcagaagcatgggagaattattctgcaaatgaagattctaggagattcttgtcattgcctgcttgattcgatgaagccttctcaatggctaactcttctgctatcactctaacctgctgttctaaggtacatttttcctcctctactgcttccatgtcaagttgaaggctctcaaattgttccttccagttatctgcctcggtatggtagtcattcatcaactgctccgtatgaacaatccttttcatcatctctgtaccaatgagattaatctacacaaaaaagaaaattagatacgataaaggctagttttaaaaagaaatcacatgaagcgtaccttcaaagatgagtgtacaatctcattcatccatgtcaaggagcgatgactttccaattttgacttttcaactgtgctaatcaaaggcttcaaccacacgtctgcctggcctgatttctttaagaggctaccttccgcagatacctcgatcataattttcttcatcacccactactataagaccctgattcaacaatagaaatggtaaactgatgttccactagagcagatggggaaaagatggcaagaggtgcctcttcttaaattgagccaaaaccttgatagaatagttgctaaactgactcattggttcctgtaggagcttttctttgagaacacaagggtagaattattaggctcaagcaggaagatggaccagtaaggggagcggattcgtcatcagatacgactcttcttcttgctcgtggcctacgtactaacggattctagaatgcgaaaaggatccaatgaattcgaatcgatctcatcaagaagaaaacctttaggctttttatccaggaacgccatgatatacctgatccatgcaaaatatctgggtcttcccgttccgtcatctggcttatgttcttcatgtagcattcagaccgaatgactctatgaaattacgtgaaaaaaaaaaaaacaatttattgtttgtctatttctggagttactttctttttctctttgtaattcttacgtcgtgagacagtttgttccatatccggtactctctttcaaggaggcagcgggggtagggtactacgaaaggaagttgatcatggattaccaataagtctaaaattgattcttcctaggtcgatgccgagcgattaatggggacggactgtaattcgttggcaatatgtctacgcgccttcctcctgctcctcttcatcttctacagcttgggtcctatccaccttcctttttgatgatgaagagcttaagatgatttcttgagccttggacaaagagagcttcgaagcagttatagcagcagcagtgataccacgagcaggaaaccctaataaacaaaaaaggatcagtgaagtttgaaaaagagtgaaaaaggtaatgtaaaaaaaaaaacctaccatgggttcttaatttccaaacaaacctagcagaaaggtatttccaagatctttcttccaccggagcaatcatcaataatttttctacccaaccacgaaagccggatatctcctcaacggttcccatgttttgctgaaaagaaagacaaaaaacagtcacacactggacgtttatcaaataaggaagaagtatagtaaataaaacttacgtgcaaagttccacttctttagggaagagaaaattttcttaacactacaatccacttgtaggggcagcaacaaacctggcataccatcctcggtctttatcatcatcagaatgactaaaactctcttacttctataacgagagtaaaactccttggtggaataacttgggagagtagagatggataagatgataaaaggtaaaagcaagtgaagccaagttagccaaatacctaaggcatgctactatcctccagattataggacgcgatttgtcccaaacacagttaataaaatcgacaaaactctataatgacagggtcgataggaggcttgaaacctaaagtaaaagggtaagtatacacaaaagaaaaccagctttgtaagaagttatcctttgattttcattgggaccaagatccgggaaatcaaatttccacaacagtttctgcgcacaagagaaatcaaaccctcagtgatttgagtaggtgtaaagatcagcgcgatcatgagacgtcatggaagtaccggattttttatggcttcactgtcatggtacaaaagaaaattcagcgggtacgatttcatctacctttggtggcacgaagcggttcactggattctctactcttagaagaagatctgtgagaagaagaaggccctagccttagaagaaaatggattaacagtagccctagaagttggtgggggagtgatgttacattgagatgaagatcctctgaggtattgaacctaaacttctcatctaccaccccttccactccgaatcagaatagaagaaggagatagttcgtcgactattatgacctttttgggatcttggtttgaagaagacatagttgcatggaagaagaatttgcaagtaacaaaagaaatatggaagtttttcgtaaaagcaaaggcaaagtggggtatttatatacagaggaaaccgccaaaaaatggcaaacaatgatgtgaatgtctttattacaactgtcatttcgtgactgatgcagccacaaaaagccctaaaatacgctgaggaattacagaaccaatccgtaatcgccacgtggtacgtgcatttaatggaagtgacaagcgatgtatacgttcagagacaggtgcaatggtatgagtaaaatggcggcaaaaaatttccgccataatgagtatccacttaccaaatatttaattgacaaataaatgataagtggggggggggggggggactatatgtattggtaaaaaaatagatattacacgtgtaatatattggatgacgaagcaagctacgtggaacaatggaaaagcgacagctggatgagagtttagtaagatgcacggaataaagaggtacgagataaaacacctacgagatgattagtagcaagagctccgatctatttgaggagttgaagagacacggtcaaaatgaactagggctgaatagagggcagattcatagatcttcaatgaatgagttaaacgttatagaatcttcatgcaatagttacgattacctattgtaacgtttcattaatgatataaatattcattaatgctcaatcataaagaagagtcgacattatactaagaaattccctataaaagagaataagatcccatttgtatcgacacgttcgaaccattgctgaaatatactttactttcttgtactcttgctattttcctatttttaaagtcttatttccactattgttttagttaattctcttgattattaaaagcccgagtactttttaaaataactttgactaaaaaccgattctttggttaaacaatagtacttggagcgacctaaagtcactacaaaatattttagtggcaaattttggggcttttgtggcgatatatatcgccacaaaaaggccggttacatgacttctctttctatatatcttttttttcttcttcttttaattcttttcttatataaaacgagtggtggatcataaatgactaattaaagctcttttttggttgtaacttagcaatcacttatataaaaatctgaattcaacattgtcaaattaaaaataatacatgaaatacaattaaatgcttataacacttaaatgttacgcaaacttaaaaagaaatgagttttttaacaccgtcctttgaattttcaaacacaaccgttatatcctcatcggcgatatcttcttccgtggtggcaataaccaaatgataagtaatcccattagcaactaataaaaaatttcccttcaacactttcttaaacttcaagtcagaaccttctattttatcgttatacgcttttatcgcaaaatttgcaatatctatcactttaggatcttttagatcttttatggttgccaatcatctgctgacggggacggagctagagaattaggtacgcgagccgaaacataggagaaggtggaagcaactactacaattgagagagtcacaaaaagaagagaatagaatttgaaagccatttttcttttaagaagaataatttgctagtggagtgcttaacacaaatggtgataagacttatatataggagaatttgaaagcaagcataggcaaaaataggaaaattgataagtttattactttagagataaattaggttacaatgtgtatacgattcgaaataaattagttacctaatttgtctaggaaaaaatgctttgttttaagtagcgattttaaaataattacacatttactgcttaattaaggaagatttgctaaaatatttcatttgaattggcatttattgcatgaatcttaattaacattgcatattttttaattacaaaaaccaaaaaggtggctaatttttgtttcaaaacgtgaaaaaataagtaatgaaaaagtgaattagagagtttaatctaacctcactagggtagtacgtcgtagatggagaaacaacaaccaaaaaagaaaatccagtttggtcccataaataaggtacggggagggtagtgtgtatgcagaccttacccctacctcatagtaatagagaggttgtttccgatagacgcccgactcaaaaaatagtgaaggtaaaataacaaagtagcaaaaaacttaaaattcattattcagataatctaaaatgtgatcacgataataaataatacaacaataattggaaataaattagtatttatcattgttttcgacatccattcaccattaatttgtggatgatcaaaaggcgtgaattgtgatggttaaaattcattcacccttaattagtgatcacgagtttgagatctaaaactgaagaatttttttgttaaagaatactttactccctttaataggtcgatcaagttcgaaatcaaattaatcaagtcattagatctaattcggataacaaaatattgaacagaaagaaacactgctatctgtcaacctacaaccctaatcatcgacctccacaccttctatagtgggtcatatcctcggtaagacagagaaaaataatactcaatcatctcttaccttgtctttacgtttatccatacttattttgcatccattatttacatcaaactataatggtgacgtctaagattaaactttagggcccttctacacacacttcaaaattaaaaattaaaaatatatattgagaaaatcaaagatgtaatcacggtaatagggaatgtatctcagaaatagattgtagtttagggtcctcctccacacttttcaaagtaaaaactaaatacagtcagacctgcctataataacattcttatattacagtatttctctgtaaaagtcaatttttttttgaaatcaaatctcatgttctattataatatatgttttcaataacaacaattcgctataacatccaaaaatattcgaaacaaacgaggttattatagagaggtttgactgtattcattagtcaaagaatctaaattatgatcacggtaatagaaaatacagcaatacttggaaataaattagtgttttcattgttttcaacatctatgcacctttatattgtggatgatctgtaacgatctgaccggttattttgagctctagcacgccgttcaatggtttgaggccttgagtagctttatttaaggtattattacttgcatgcgtagtcagaattgaatttcgggaagttcggagttgatttggaaaggaaattctcatttcggaagctttatgttggaagaattgactaaagtgtgattttttagtaaacgacctcggaatcgggatttgaaggttccaacaggtttgtatgatgattttggacttgggcatatgtccgaatcaggttttggatgactcgggagcgtttcaacgcctattgaggaagttggcattttcgaagaatttcataaatctgggttgaggtgtatttcaatgttatcgatgtcccgtatggtgattctggtattgggagcgcgttcgaaagtggagttggaggtccttagttcttttcagggtcatttggtgaaagttataaatttgaaggttttcgagaagtttgaccgggagtgaacttttttatgtaagggtcggattccgattccgattcttgaagttggagtaggcccataatgtcaaatgtgacttgtgtgcaaaatttgaggtcaatcggacgtgagttgataggtttcagcatcgaattagaaattgaatttcttagtttcattatgctcgaattagggtgcgattcatgtttttagcattgtttgatgtgattagaggcctcgactaagtacgtgatatgttttgagacttattggtatgttcggacgggtttccgaggggctcgagtgagtttcggggtggtttcgaaccatttctaggctatttttaactgctgatttttggctacaacagtgcgctacgcaatcgcagggcttggtcgcgatcgcgacaagtaaaatgagagaaattggccagtgattcacgatcacagaaggcctttcgcgatcgcgtagagaaaagtttctgttgcactgacctgattttggaagcttgtatgttgtaatctataagaaatttgaagatgatccaaaaataaaagttgtagccctttgtgtctaggtttcagaaagttaaatcatttggtatttgaagttgtgtacaaaaagttataagtggtagactacaacctatctgggaagagtttagaaatcatgaagaaaaagtttgtgttgcacatgactgaatttgaaaaattatatctcataatctataaggaactaggagatgattaaaacatgatactgttagtccttggagtctagtttttgaaatgtcaaaccatttgtaatttggagttttgtacaaaaagttatgatcattatactagaggctgtatggaagagctaggcatttatttttcgcgattgcgaagcattttccgagcgaaaggcaaattttgggctgagaaatgttgtgttttgcgatcgcgaagaataaatacctgggcagaaactatattttgaggtttgggccatttttgacatatttgaagctataaagctcggataaaagcaatttttgaggcgattttcaccatattgattgaggtaagtgttctatatccaaaagtaattatactttatgatttaatggttatattcatcatttattttagattaattaaaagaaataaagatttttgtaaaacttttcaagaacgaaaatttaagatttggagtcaattattattgaaatttgataaaattggtatggttgaactcatatcggaatgggttgtcggaattcgtgttttatagggttccgaggcgtgggattcactgtcagcttttcgaggagagttgagaatttttataaattattaaatttcaagtattagagtatatttttaattaatttgcacgttgtttgactagtttcggattgaacatcaccaagttggggctttaaagcgaaattgtgaccggaaagtgggctttaagatgaggtaaatctcctttctaaccttgtaagagggaattaaccccataggtaaactaaattattatgttcttctatttatgggagctacgtacgcactaggtgacgagagcccgtacgtagctactagccatacctaagtctgggtagttttaggcttacatcatgccttgttgttatgttattgatttatgtttattgttttccttgagagggagcaagattgagttttcttaataaatattttgagaggagttgaagttgaagaatttaagatttaaaaggtttcgtttgaatattgtaatttcgaatagagaattattataatagcgtaagaaattcaagtgtaacagcgtcgtatgcatgtttcgtgagcggggttattttaaagctacaagctgaattttttattttgaaaagatcaagaaagagatatgattttaatattaaatttatatttgatcgcgtcgcactatgattcgcgagtggggtatttcttctactacttttatgggatcgagccgttcgcctcggtaggatttatgtaccacactctcatgggagcgagacgttcgtctcggcaggttaatagatgcatctatggttcgcgccgttcgatcctcggtagtgcacaatttatttttatattggattgggccgttcgatcctatatatatatatatatatatatatatatatatattatatatattatatatatatatattatccttatagaatcgtacataatatttggcaagacgccagtgtatctgagggtcttcccctgatttgaattatgacaacctctttgatgaaatccactatatccatgtatatgctccggttacggagggaacttgctagttgagagctgagtaaattgtaaagaggggaattgtaccacatattttatacttgtttgtttcatatatttactgtctcatattcattcacttgtttactgtacctgatattattggaccactagtaagtgttgaagtcgatccctcatcactattttttcgaggttagactggatacatactgggtacgcgttgttttcgtactcatactacacttgctatacattttgttgtacatgcacatgtatgtcttgtggcctagtgggcgcggcggcatggttgatacgaagacttagatgagctgcatcttattagccatcagagtctccatcataatatttgtattttcttttctgtccaatttatattccggacagttattttattttattttttctagtaaatgctcaagcactcgtaacctcgggttctgggataattatgggatattcagtattgaaattgtaaacatttttatttattttgtaaagattatcttttactagttacattaaagaaaatttacgatttcaaaaaaatattaaaaacgagaattttaagtaactatttagtgttggctagcctaacagtgatgtccggcgccatcacaatctttattggattttgggccgtaacatgatcaaaatgcgtgatggttgaaattcattcaaccttaattagtgatcatgagtttgaaatctaaaattgaattttttttgttagcgaatacgttactcccttagtccatttaataggtcgatcaagttcgaaatcaaattaatcaagtcggcagatctagctcgaatattaaaagattaagtagttaaaaatgacagttcattctatttttttcttctcgtaagtcactaatcaattcaagctcatttttttctgttgcaacttaaaaataacttatatcaaagttttgaaattcactactctcaaaattaaagtgtggcatttgaaatatatgtttaaaagctgaacaagataaaactcttatttctcatatgtatgtcgccacaaaaaggctgatttcttacttctctttatatcttatttcttttttaaaaaaaattattttcttatgtaaaacgagtaatggatcataagtgactaactaaagatcttttctggttgtattagcgatccttgcattctctcacaatggatccttaaccttatgcaacccaagactcaataccacccaaacctcctgacattgatcaagctaatctcaatcacaacaatacaaaaaaaaatcatccttcagggatgcgttaacaacctctaatctaaatttcttcacatcaactgaaaatcaacccgaaatagatctttcaatgactaattcagacgagcacttggttgaacactcattactagaacacacacggggtatcaaattcatattattaacagaagagtagaggcaacgaatttatgagccatggaaaaattccatcaagtgctaggctgtgttgtggagcttacgttagaaatcccagtacaacctttcctctttgtaggccatcataaacaattcatacactgtgaaggagaaaatttcctctgtataagttgtggtcgactaggtcacacaacaaggcaatgtatatacatttcacacagtactaaggttaagggtgagccaacaatggggaaatcagaaacaacaaaggtagacaacatccaagaagaatggaaaatagtatcattcgctaaaagaaggcagcaaggtgcaagaggtaaccaaaaaaatctcaatgcaaacacaagcaaaaactccaatggtccaggtatctcagttaacactggtaagtacatggatacacaaatattacaatacaaaatcaaggaacctaataaacctacttccttggttgacaaaaataaggaaaataagacggctataatggtggaaaagaatactactttgccaacaaaaaataacttttctcttctaaatgatgagcaaatggttttacttgaaacactaatgaggaggtaaatcaaaaagaaattactaatatttgccatgcaattgaacaaatgtcctcttctaatatagattttgccatgttggaaaataacgtgccagcccctaacaaaaaggaaaatttgacaagaaaaaagccatgcaaaaaatcctctaaattacaattctaaccctccaactatacatgatcctactaccactaatgaacttactaacggccatttcggtaaaatagctcccttaaccgtaaatctaaaacaaaatccttctttaggatttggaaatccttccacccctaggcatgccatccaaatggcaaagaagaagacaatgaaggaaaaatatcttccaaccttgtgcacgcaatggatactacatccatgaaaaatcaccctataagaccacatattgagcatccaaacgctaggcaagaggcagccccaatcattaacctatcaaccaatcgatcccattcctccggtggcccccctccatgcctaccctagactcattaagtaccaaggatcctattcaccatgcccagaatactttcctccttgagaagaagatacaggcttcttcaacttctacgctaacacagaacccaaatcatggaaaatcttccatcactacccctcaaccagaaaatccccagatcatttacgtcctacctccacaaccacaggattatcagcctgtatcatggatggaaatgggcctgatgggccatgcatgctcgttcaacatccaaatcaatgggcagggctcgatcatcatactccacgacacacagtatctaacccaacaggtaacagagcgcatgaggttggtcatgaacaattacctaaaccaggtctggctcaacaatatttttaaacctttagcaccctcaatgaacccccaactaatgcatgcaatgaggaaccaatggaacttaccttctaatttcaaccccatctaccctcagaatgctctcctagacatgcccttcttcctaccagagacactaactctactcagcccaatactcctgccttaggaacaactttaaccagtccaggagccaccaactcctccacctcaccaacaacctccaccacctcctcaaaatcaggaccaagaaccaacaccggtagaggcagaaatggaggaagaggaacccctaaacctactcttagaaagagacctagaaatctcaagtcttgacggagtaaaagtatttctctttacagagaggcaagagaagaggcatgtactcaatttcccactagcattatacaaatgctcgatggacataaggcctccacaggacccaacagtgggcaacagggccatgatcctagttccatcattgagaaggaacccagttttagggacagtgagacagaatgggaagccggcaaactcaaatcttagtttatcaatgaatcgacctacaaacttcatcatttggaacattaggggaggaaataatgataattttagaaggaacttcagggaaatgatagatacccaccggccctgcatggtagcactattggaaacaagaatggaaaatcacaatgagttgcttactagtgttggttttacggagtttattgaggtgccagcggaggggcaagcaggaggtatagtgatactatacaacagtgaggtagtcactgtccaaaacttcgtccgtagagatcaagaaatacatactacaattgaggtattgcctattcgtaaatattgtctttttagtgctatttatgctagtactaatatacatagtagaaatataatgtggggaaaccttgaaaatatattagtaggacttacagtggaccatagttggtagggggagatttcaatgatattttgagtattaatgaaaaatttggtggtagctcaattaacgataatagagccaaaatttctatggtaaaaaataaacaattgcaatttatttgatcttggttttaaaggttccaaatttacttggtctaaccatagacacaagaataaaggactcattatggaaagactagacaaagtactaggaaatgaggaatgagtcaatttattcccaaaaagttcggttatccacctccctaaaactcattcggatcataaccctatcctagtagaattgatccctagaaataattcacttcacaaacaaccctttagacttgaagcattctggtgtaaacatgcagaattccaaactctagttcaaagtaattggtataacacagactattttagagctagccaaagtttcatagataaagttaaagattggaagaaccaaacctttggtgatatcatgggtaaaaaatgaagacttctagctcgacttaatggtgtccaaaattctaaacattatggccatagtaggttcctccaaaccctagaaactgaaataaaaaaggattacaatgacttgctcaaaattgaagagaattattggaggattagatctagagtcctgtggcttaatgagggagatgctaatacaaaattcttccacatctcatcctctaatagaaaaagaagaaataaaattaacttctttaaagataatgaaggaaattggatcaatgatccttatcttcttatctctcatgtccttaattatttcaccaaagttttcactacttcacaagccataataagccggattagtctcctaaaaaataactcttctcaaaacctcttaaacctaagctctcttgacatccctctgctagatagtgaaatcaaaagagctattttctcctttaaacccttcaaagctccgggactggatgaccttcaccttttcttttttaaaaaatactgaaaaattgtggggccagcagttacaaatttatgtcacaatgtttttaataatcaggaggtcctaaaagacataaataaaacctacctttgtttaatttcaaaaatccctaatgcaaataacattaggaatttctgacctattggcctatgcaataccatttataaacttatcaccaaaatcatggcaaaatcgtctaaaacctttccttgatcagcttatcagcccctttcaagctaactcatgaaaaatagaagggcatccgataatgctgttatcattcaagaactagtttccaagctcaaaaaattaaaaggaaaataaagccacatgattctaaaaattgacctagaaaaagcctttgaccgattagaatggtcctttgcccattacactctaacttatttcaactttcctccaaaattcaaaaaacttcttctaaattgcatatcaagttgttcaatagcagttctagtgaatggctccattactaccttttttgaacctagttgaggaatcaggcaaggggatactttatctccttatatcttcatactttgtctagaaatgctttcctgatacataaactatcaagtcgatattaggaattgggatccgataaccgtaggaaaaagaagtccaaagttctcacacttattctttgcagatgatctcatcttaatggcaaagtcaatacggaatcatgccatataatccagaaaggtatagaaattttttgcgacctatcaggtcaatacataaacaatactaaattaaaaattatcttttcgaacaattgtccccaagaccttattaaggagattatcaataaactaggcataaaaaaagtgattcctttggcacatacctaggcttccctattctactcaaataccctaaacctaaggactaccaattcataattggtaaaatgagaatcaaactagcggcatggaaaatgaaattcattaatatagctagacgaactactttgtcccagtcttgcttgaactcaatacctagccattatatgcaatatactcttctgcctactaggattcttcacaaaattgataaaattcaaagggatttcattttgggtactaccaatgagagaaaaaaaatccatcctattaaatggtctactatctgtcaacccaaaagtaaaggaggacttggtctccacaatgcaaaggataaaaatatttatacccttgctagacgtatggagaatcctcactaacggtactactccatgtgctaacctaatcattatctcctataccaatagtcatgcaaaaaacaaaaattctttcatttggaaaagcatacaaaagggttgggaattatgctctaaaggtataatttggtgtctccatcatcatacaaacactaatataatatttgggtactaattggattcctaaattaggtggccttagagaaacaattcaaggacctctcctaactacaaattgttctctcaaaataaaagacatctatgaaaatatttctttcgaccttcccaatacaatcaagaataatatgtctaaagtagaaattcgactaaagaatcctaaaaatgatattccaatttggtctctcaatactaaaagtatattttcatccaaaacgtgctacactataatggatcctaatactgacatgcacatggattttaactggatatgggacctaacatgccctaataaaattaagttctttctttggcaatgtctccaccactggattccatgtagagcatacctagcaaaaattggtttaaacatagacccaaattgccctatatgccatgaacaagaatccatattgcacatcttctttaacttccaagccactaagtttctttgagacaatattgggtggcataataaatataatgatcaaggcgatcactggcttatccaactaaaagattttgactaccctattaacaataagattttagattggaatctctttttccattttgctatctggcacatttggttaaatagaaatcaaaacaaccaaaacaatacgggtaaccctattaatataaaccaaattattgctagggccacagaattcctgctccttactggaaataatactcacacctctccaaaaatcatcatcaatattaaatggcatagatttcctaatggttggttcaaactgaacattgatgctagctataacaaagatactcataaaagtggtctgggaggtgttatcagaaatgcaaatggtcaatggatagtagggtttactaagaccacccatgcctatggatcattacaagctgaaatcagagcacttctagtgggagtcaaaacaactcatatttggggtctgtttcctcttcaaatagagacagactccacggaggtaatcctttcaatctagcaaggtaatagactctatgataatatcattaataaatgcaggttgttaatgcaccagctgaaagaggtaatcgtgcaacacgagttcaggcaagggaatagagtagcccatcaaatgacaaagaaggcatctcttgatccaatgaagaagaaaagagtttttgtggtaccaccagatatgtaaaatatattgtagatggtgatctactagaacaatatgtttttgataaatttctgtcttatgaagcttgcaagaatctagcaagtgtaggtaacaaagtgtcctaagtaacacaaactatgaaaactatgtatttctcgctacttagctattaatatatattctctgtttaaaagttgactcgtttaaaagttgaacaagataaaatgtccacaagtagtttgaagacaatttatgagattcttcaaaaaaaaaaagaaaaacccataactaatattgccaaaagaataagcaagacgaagcgaaaaattaaatttgagctatttcattctttaaataatgggttgtagatgcttataacacttaattgttacgtaaactttcaaagaaatgagttttctaacactgtccttagaattttcaaaaacaactgctatatcctcatcggcaatatcttcatccgtggtggcaataaacaattgataagtaatgccatcagcaactaatcgaaattttccctccaacacttttttaagcttcaagttagaaccttctattttatcgttgtacgcttttattgcaaaatttgcaatatctatcactttaggatcgtttaaatcttttatgggttgccaatcatcttctgatggggacggagctagagtatgtggtacgcgagccgaaacataggagaagatgaaagcaactactacaattgagagagtcataaaaagaaaagaattgaatttgaaagccatttttcttttaagaagaataatttgctagttgagtgctttaacactaatggttatagacttatataggagaattcaagagcaagcataggaaaaaataggtaagatgataagtttattactttagtgatgattaggttacgttgtgtatatgattcgaaataaattagtaacctaattgatttgttttaagtagtaattttaaaaaattactataattttactacttaaggaagatttgctacaattctaagaaattttttctatttcatttgaattgacattgtgcatgaatcctaattaacattgccatatttttaattattgtgataacccaataggtcatctcatgttttagaactaaattttgtgtttttgaatacttaaataactcattttagcctttctcgacttgtgtgtgcaatcctggtattgacctggaaggcttatatgttaaaaatgataaaaccaagaatttttatcttaaaagtgaattttggttgacttcggtcaacattgtgagtaaatgaacccggatttgtattttgataaatcagtgggtccgtattgaaatatgggacctgggcatatgcccggagtcaaatttcgaggtccctagcttgagatatgaatttttgtaaaaaaattaaaagtctgaaaatttaaatggttttaagaatttattgatgtttggcattattgataccgaggccgtattttggtttggagcttggtacagttttaatataataattataacttgtatgtgaagtttggtaagaaacagagtcaatttgacgtgattcggatgctcggatgtgaaaatagaagttttaaagctttcaaaatttaattcgatttggtgttcaatttgtagtttgaggtattaatttggcgatttgatcgtgcgagcatgttcgtagggtgttttaggactcgtgtgtatatttggtttggagccccgagagctcggggaattttagataggttactggacgttttgggacttaggaaaaatctggtttctgtagttcagtgccttctggtttccttcttcgcattcgtgaagacactctcgtatacgcgaagtagaaactaggcggtctaaattttatttcttcgcgaacacaaagtgatggggctttaatcttcgcgaacgcgatgctttagagaccttgggggagggttagtcgctctttatcgcgaacgcaagcaaggactcgcgaacgcgaaagccagggagtttcacgattgcgcaagtttctaggatgaagctctttgcgaacgcgacagtgtcctcacgaacgcgattaacactgtcgcctagctattaaacagtcacattatgggacttaaagtgttggtaagtgattctaaaccttttctttcaattacccgttgtattcatgaatttttaacctaaatctaggatttccacggtagaaattaggtgtttgggtagaattagagattttttgaaaattgagatttagacctcaaattgaggtcgaatttcgaaactaattgcatattcgggctcaggggtgaatggggggatgaatgagttttggttcgaacctcgagttttgaccaagtgggctcggggtcgatttttgactttttgggagaaagtttgggaaacctaaatttatgcattgtaattgattttttttagcagtatttgatgttatcaagttaattattgctagatacgagtggtttggaggtggaatctaaaggaaaatcggtaattgagcagtgagtgtggcctgtggagcgaggtaagtgttgtgcctaactttgacttgagggattaggaattcttgccttaattgctatatgaaaaatcatgtgagcaacgtatatgtgaggtgacgagtacttatgcgccaccaatttacctgttttgcttgtttctttcccgtctctttttattgtttcttccctgctttaattattacatgcctaattgtactgccatgcctaattgctacatgttagatgttatttctccttgttgaatacacttgttgtaccgtagtttccttatcccttacttgcttaagctgttcttacttgtgttttagtgatattctggattggtctcgctgaatagtattatcagtgtagagttttattaagtgtaagatttctatttgccttgtgctgaagtttaattattgagaaaggtcttgtgttaatttgagaaacttctatactttctgtgtaattgatattatacggtgggaacgggttgcacgctgcaacaggtgtaatatggatgggatgtggtgatataagagggaacaatatttgtaattattatgatatggtgggatcgggttgcacgtcgcaacatttttatttatattttgttatttatgatattaagaagaaataagggaggattgtgatatgtacggtggaatcgggttacgtgccgcaatagtttatatgtttatgttctttctttggctatgttagttgtttggtagtattgaattgcacttaaggattggtaatagatgagcactgatgaagtttgttaggtcctgcatttattccttgcaagttactgtttttactttattctgctttcttttctgtcttattattcaatgtatgcagcttatattatgagtgtcccgtcgtagcctcgtcactctttcgtcgaggttaggctcggcacttaccagtacatgaggtcggttgtattgatactgcactctacacttcctgtgtagattttggacaaggtagtggctgatcgagaggttggctgtagattatacaactaggagacccaagataatcttattggcatccgcaggccctgacgtcctcttcgatactcctatacctactttttacgttacttcacaaacagttgtatttttttccatcaagtggctatttttttccaaaacgtggaaacataagaaatgaaaaagtgaagtatagaactaaatctgacctcactggggtagtaggtcgtagatgccgaaaacaaacaaacagcaaaaaattcaggttgatttcataaagggagtttggggaggatagtgtgtacgcagacctcattcctacctcataaagatagagaggttgttttcgatagaccctcgattcaaaaagtagttaagataaaacaaccaagtagcaaagaatagtagcaacaatgtaacatggtaacaagcgtgaatgccgcggtatataataataaagaaacataaataggaaattaaaaaaatagtcccagtactgccggtcagcctagaaggtacacactactatctatcaatctagacctctaatcctcgacctctacacctttgttatttgcacccaatatttacatcaaattataatgcttatgcctacaattatatatatacatagaaaatcaaagatgtaatcacagtaataaggaatataacggggaaatagattgtactttatgatccactccacactctcaaagtagaaactaaatactcattattcagagaatctaaaatgtgatcatggtaatagaaaatagaggcatacttgaaaataaattagtattttcattgttttcaacatcaactcaccctttaatttgtggatgatcaaaaggcgtgatggttgaaactcattcatctttaattagtgatcacgagtttgagatctaaactgaattttttttgttagagatactttactcccttagtccctttaataggtcgatcaagttcgaaaccgaattaatcaagtcgacagatctagctcgagtatcaaaagattaaattaaaaaaaattacagttgactaatatgtttctctcttcttttattcattttctcttttagttcttatttttgtgttaaacgagtcgtggattgtaactcgtacgtaactaatcaattcaagctcttttttatgttgcaacttagtgatgacttatatcaaagttccaaaattcacttttctcaaaattaaagtatggcaatcgaaacatatgttttctcgtttaaaagctgaaaaagataaagcgtcaacattaggggtgtacatatgtcgggctgtttaaccaaaaaaataggatttttaattgaaacctatatttagaagaaatcgggctactgataaccaaataataccttacttccttaacaatccgtttgaaaagaaagaaataaaaataacaatgtgaattagcaaaaagatattaggaatggaatgataatctatccctcaaattaagtagaaggctttggtaaagcaagaaattgtaaatatatttcagtagttcttggaacttgtccttacaagtgagattctctatccttatttaggagtatctaattgtaatatttttttcctatttatgacaaattcattatgagcaataatggtattgattgctcgttgtcgttgataaccataactaacgtactcgtagctataaatgccttataatgattcctattccctttccttatttactgctggtttatgaatctttcctcctttttgtccttgatcctttccgctcggcctcctcttcaaacaattgtttaggcttgatcatttgttctttaatatcctgtgggtgtttagtccgcatcttccttgaactcttaatttcactaatggaatatgccagttgtcacttcgccatttgtaacgacctggtcgttttgctttctagaatcctgttcccctaaataagactctccgtatgtgcttttactgttttatgacttgccgggatggttagtttgagatttgaaagggttcggttgaaatcggaacaatttattccttaagttggcctaaaaaggctaagtttgacttcggtcaacattttgagtaaacgacttcggaatcgagatttgacggttccaataggttcgtatgatgatttcgaacttggtcgtatgcttgattcgggtttttggatgacccaagagcgtttcaatgcctaatatcaaaagttggttcttgaagaattttaaaggtctttaaatttggtttggagcgagttttggtgttatcgaggcccaaaccgaatttcaagaccgggaatagttccgtaatgttattttagacttgcacgcaaaatttggtatcaatccgagtagtctaagtacgtttcggcgcattttaagtgaatagaagaacttgaagttcataagtttgaatcgattgattttggggtgcgattcttagttctaatgttatttatgcgttctgagagttcaagcgagtctgttttatgatttcagactagtgggcatgttcgggcggggccccgagtgtcgatcggatgaggctcggactaagttagaagttgggagcagctgcagaagctctggttctgtcatattcgcacttgcacttggccaatcgtaggtgcgagccatgagctgtagaagcgaaagtgtgaaggaagcccagccaccacaggtgcagaagaatttacgcacctgcgacaccgcatgtgcgagaactgtggtcgcaggagcggaagggcttgcagaagcagctcattgtgtccgtaggtgcggagcccagccaggtgaggaaaaggcgcacttgcgaaggtcttgctgcaggtgcgggatcgcagatgcggccaatgcactgcaggtgcgaaaatcactgggcagtgagaattcatttaatacagacttaggccattttcatcacatttttctttcattcttgggctatttgagagtttttaaggagggatttcgacctagtcttgtgaggtaagtaatttctacttaatgtgagtttaatacatagattatgggtagaatttaacatgaaaattggtagaaatcatgagtttaggataaaaaccttgggtttaataaaaatggattttaccacgaaaatggttatggaacttagtaaaagtcatatatttatgttcctcaggttatgggtaacaactttcttcgaaaatatctggaatccgtgcacgtgggcccgagggtgaattttaagaatcttgcattttgggttgggtaatcactttaatagtggggatatgaacttttgagcatagattgattaatttatataatgtttgactagtttcggatcgtgtggcaccaagtttggagggttgagcacgttcttgaatcgggaagtgggctttgagacgaggtacgtctcctttctaaccttgtaagaggaaaatctccccataagtgaattaactaatatatgtgactatttgtggggggctacgtacgtatgaaatggcgagagcccgtgcgtagctactattcatgctaaggtccgggttgtctaggacccgtatcatcctatacttgaaataattgtgcctttacttgtcaattagattgcttaaatcgtagttctataaattgtaaaagaattccaaaaggaggtcttcgatcatttgaggttatgaatagaacacttgactgtcattgaaaaatttgtgttttctttaggtgttttatattgtggagcgggtcgagcgcctcggtaggttaaatagatgcatctatggttcgcgtcgttcgacccttggtagtgcgcattttaaatgctattgtgttagttcgggccatacgacctcggcattatttgcgcatgttaactcttgagaatagtgattgtgaaaaagatatttatcatctcttgctgttgtgtttagcatatttgttgtaatccatgcttagttatgtgtaacttattatatttagctttcgtaagtgtcaagtcgatccctcgtcattgctttttcgaggttagactggatacttactgggtacatatattattttatgtactcacgctacatttttgcacttaactgtgcaggatctgaggcaggtgcatctggatacacattcggcgcaatcatgattttggttcgagattctacggtaagctgccctttcgagctgtttagcagcatgccaaagtctctcttttattttatttatgtctattctttttcggacagcaggacatacatcttttgtttattctactaagttgcccatatacttctgacactagaacttggcatgtattagtagacttgtggtttttgggttctattcttatggttatgaacatttcttcttgcttcacttattaattcaaatcgatctctcatcaaatcttttaaataaggaaaatcacaacatgggaaatttgttaaaacgggaatgtcattaagttattcgttattggcttgtctagcaacgctactggacgccatcacggcctgatatggaattgggtcgtgacaacttggtatcatagcactaggttcacgtaggtctcacaagttatgggcaggtctaatacagtcttgcggatcggtgtggagtcgtcagtacttatcttcgagaggctataggatgtgagaaaagtactcttcattcacctcctatcatgcagttgatggtgtactaagtttcttcttttgtattatctgacaaatgatgagaacgcgcgcaacagatgttcctgacccaggaggagctgctccctttgttgttagaggccgaggcagatgtcaggggagggcaccggcccgaggtaggggcgaggacgtaccagagttgccccagttacactgccaccggatcttgtggaggatgctgtagttgaggagcaaggagaggtgcccgcaatagagctggccccagacgacttcatgaaagcaccaggattctaggaggtcatgggtcgtatgctacggttcatagattccatgactccggccgaattatttccagcagatccggccacatctcagacgggagggggagcgcagaccgctaccgctaccgctcatgcttctggggttgcagtcgctatgtatcatacaccggggacccttctcgtgggtggagtccagtagtagcagcagctgtacctgagcctagactagctgctgtggcgagacgcagaagcttttagaaaaatggactaggcttcaccctccggtctttgggggtgagcgacacgaggatcctcaagacttcattgacaagtgctggaacagactgcataatatgcgcatattagagtctcacggggtggatttcactacctttcagttagagggcagcgcacattggtggtggcagtcttatcttcttggtagaccagcaaattctcctcccatgacgtgggaccagttcacacgcctatttttggacaggtatcttccaccctctcagaaggaagagctacagtttcagtttgagcagcttcagcagggtcagatgtccgcgactgattatgaggtgagattttccaagttgtctcgccatgcacttatgatactccctactgaggtggagcgagtacggaggtttgttgcggggttgcactcaagcattcatgctggtatggctcgggaggttgagatgggactccctatcagttattggtggagatctctcacaggattgatggttaccacctgaggggtagagagcagatgcagtgagacaagaggtttcgtttttctggagagttcagaagtgccccagctgagggcagaggtcattttgggaggggccaacttagtaggcccccatattcaacaccaccacctcctctaggtgctccagtgaggccctatttcagtgttatgccggagagttattacctccccctagctatccagggtttttccagcgggtattttggtcatcaatttttctttagtgccatgctagagagttcatatcgcccaccagctattcaagaatcttctggtaggtatacatgccatcaaggtcagacttcggggtagtaggtcaccgcatcgagaggttgttttgaatgcggcgatcttagtcatgtgtggagatattgccccaggctttggggcaaggcaatgcaacaaggtcagcagcccattattacagctccaacagccgcacaagctgttcggcctcctagaggcgtagggcaagcaggtagaggccgtcacagaggtggaggtcaagcatgcagaggttagttaagaggtgctctagccagattttatgcttttcggtcagaccagatgccgtgatcacaagtattatctcggtttgcgatagggatgcttcagtattatttgatccaggatctacctattcatatgtttcatccctgtttgctcattttttggatattcctcgtgagtccttgggtactctcgtttatgtgtccacttttgtgggtgattctattgttgtggatcagatctatcggtcctttgtggttatattctgtggatatgagacaagagcaaaccttctgttgcttgatatgactgattttgaggtcatcctgggcatggactgtctatctccatatcacaccatccttgattgccatgccaagactattaccttagcatgctagagttgtcgaggttgtagtggaagggttcatttgtcagatcatctagtcgggttatatattttatgaaggctcgacacatggtcgataaaggttgcttggcttatctagactatgtttgagatactaccgcagtgtctccgacgattgattcagtgctagtagtccgggattcgccgatgtgtttccttctgatcttccgggcatgccaccagatcatgatatcgatttctgtattattctaagaactcagccgatatctattccaccatcccgtatggctctgaaagaattgaaggagttgacggaacaacttgaggagttgctagccaaggggtttgtcaggacgagtgtgtcaccttggggtgcaccagtattatttgtgaagaagaaagacgggaatgtgtggatgtgcattaattaccaccatttaaacaaagtcaccattaagaacaagtacccgttgccgtgtattgatgatttgtttgaccagttttagggtgctagggtgttttctaagattgacttgagattggggtaccatcagttgaaaattcgcgactccgatgttccgaagaactgccttccgtactagatatggccattatgagtttctagtgatgtccttcggcttgactaatgccccggtgacatttatggatttgattaatagggtgttcaggccttatattgattcttttgttattgttttcattgatgacatcttgatttactacatagcatggaggagcacgagcaacacttgagagtggtgcttcataccttgaaggaactgaagctgtatgctaagttctccaaaagtgggttttggttagattccatggtattcttatggcatatagtattaggagagggtatcaaggtggacccaagaagattaaggtagttcaaaattagcctcgtcctacttcgacgaccgagatcaagtgttctttggggttagtaggttattaccgccggttcgtggagggattctcatccattgcagcactccagtaccattgactagattgacccagaagggtgcttattttcgttggtctgacaattatgaggcaagctttcataagctcaagacaactttttggccacaacaccagtccatgtgttgccttccgatttggggatgtatactgtgtattgcgacacttcacgtgctgtcttgggttgtgtgttgatgtaggagtggtgagttattgcatatgcttcatgtcagctgaagccccatgagaagaattatcctgtgcacgatttggagccgcgactgttcatgctcttaagatctggaggcattatctatatggggtgccttgcgaggtttacaccgatcatcgcaatttgcagcatttgttcaagaaaaggatctcaatttaaggcagcatagatggcttgagttactaaaggattatgacatcaccattctttatcattcgatcaaggcgaatgtagacgtacatgtcttgagcaggaaggcaaagagtatgggtagtttggtattcatttcagcgaaggagaggcaactagacttggacattcagtccttcgctaacagacctgtgcggttggatattttggagccattcgagttcttgcttgcatcgttgcccagtcttcactattggagcaggtcaaggctcgacagtttgatgatctacacctgttggttcttagagagacggtactatagggtagtgccaaggaggtttctattggcgaagatgatgttctgctactccaaggtcgtctatgtgttcctaatgtctatggcctgagagagagaatcctagaggaggcgcacagttctcgatattccattcatccagatgctacgaagatgtaccgcgagctgaagcggcattattggtggcggctgatgaagaaagacatagttgagtatgtggctagatgcctaaattgcaggtaggttaagtatgagcaccagaggacaagaggtctagtccagcagatcactatacatgagtggaagtgggagcgcatcactatggactttgtagtaaggtttccgcggaccttgcggaagttcaatgcagtttgggtcattgtagacagattgaccaagtcgacacactttattcctgtgatgactacttatacttcagagagattggcccagatttacgtccaggagatagttcggttgcatggtgtgcccatctccatcatttcagacagaggtcctcaatctacttcatatatttctagaaagtgatagagattgagttggggacccccatagagctcagcacaacattcatccgtggaccgacggtcagtcggggcagacagttcaaatattggaggatatgctcagagcatttgtgattgacttaggagggcaataggatcaattcttgcctttggctgagtttgcttacaataacagttaccagtccagcatcgagatggctccgttcgaggctttatatggtcggcgatgttgttctcccattgggtggtttgatccctgcgaggctaagttgtatggcactgatttggtgaaggatgccttggaaaaggaaaagttgattcaagagcgactctgcacaactcagtcctgacaaaagagttacgtagatctgaaggcgcgtgacttatcattcatggtaggcgagaaggttctattgaaagtcttgccgatgaagggaatcatgaggtttgggaagaaggtcaagttgatcccaaggtttataggcccatttgaggtgttgaggcgagttggggaggttgcttatgagcttgccttgcctcccagtctatcaggagttcattcggtcttccacgtgtcaatgctccagagatatcattccgacttgtcgcatgtgttacacttcagcacgattcagttagatgagagtctagagtctaggttatgaggagcagccagttgccattgttgataggcaggatcgccagttgagatccaagaggatttccgcggtgaaggtccagtggaggggacaaccagtcgaggaggagacttgggagtccgaggaggacatgcggagcagatatccttacttgttcaaccctctaggtatgcttccagacccgttcgaggacgaacgtttgtttaagaggtggattatgtaacaaaccgaccgattgttttactttcttgaaccctgttaccctaaataagactctcggtatgtgcttttactgttttatgacttcgggtatggttagtttgagatttggaagggttcagttgaaatcggaacaattggttccttaagttggccttaaaaggctaagtttgacttaggtcaacattttgagtaaacggccttggaattgggatttgacagttccaataggtttgtatgatgattttggacttgggcgtatgcttggttcgggatttggatgacccgagagcgtttcggcgcctaatatcaaaagttagttctttaagaattttgaagttctttaactttggtttggagcgggttttggtgttattgaggcccaaacagaattttgagaccgggaatagtttcatattatcatttagtacttgcacgcaaaatttggtatcaatccgagtagtctaagtacgtttcggcgcattttgagtgaatagaaaaacttgaagttcataagtttgaatcaattggttttggggtgtgattcttagttttaatgttctttcggagtttcgaaagtttgagagagtccgttttatgattctagacttgtgggtatgttcgagcggggcccaggggcgcagagtgtctatcagatgaggctcggactaagttaaaagtagggagcagctactaaagctccagttctgtcataatcgcacttgtgcttggccagccgcatatgcgagctcgcaggtgcgagccatgagccgcagaagcgaaagtgtaaagaagcccagccaccgcaggtgcggaaaaggcacctgtgagaccgtaggtgcgagaactgtggtcgtaggagaggaagggctcgcagaagcaactccttgtgtccgtaggtgcagagctcggccaggtgaggaaaaggcatacctgcgaaggtcttgccgcaggtgcgggactgcaaatgcggccaatgcaccgcaggtgcgaaagtcattgggcagtgcaggttcatttaatacggacttaggctatttttatcacgcttttctttcattcttgggcaatttgagagcttttaagaaggggatttcgacctagtctcctgaggtaagtaaatttctacttaatgtgagtttaatacatagattatgggcagattttaatatgaaaattggtagaaatcatgggtttagatgaaaaacctagggattaataaaaatgggattttactacgaaaatggtcatggaacttagaaaaaatcatatatttatgtttcttaggttatgggtaacaactttctttgaaaattttcagaattcaggcacgttgctcggggtgaattttaggaatcttgcattttgggttgggtaatcactttaatagtggagatatgaatttttgagcatagaatgattaattcatataatgtttgactagtttcggttcacgtgacaccaaatttggagggttcaacacgttcttgaaatgggaagtaggctttgagatgaggtaagtctcctttctaaccttgtaagagggaaatctcctcataggcgaattaactaatatatgtgactatttttgtggggctacgtacgtacgaagtggagagagtccgtgcgtagctactattcatgctaaggtccgagttgtctaggacccctatcatgctatacttgaaataattacgcctttgcttgtcaattagattgcttaaatcgtaattccataaattgtataagaattccaaaaggggaagtcttcactcatatgagtttatgaatagggcacttgactgtcattgaaaaacttgtgtttctttaagtatgttctattgtggagcaggccgagtgcctcggaggttaaatagatgcatctatggttcgcgtcgttcgaccctcggcagtgtacattttaaatactactgtgttggtttggaccgtacgacctcgacattatttgcacatattaactcttgagaataatgattgtgataaggatatttatcatttcttgttgttatgtttagcatacttgttgtaatccatgcttagttctgagttgacttattatccttaagcttagtaagtgtcaagtcagcccctcatcactacttcttcgaggttagactggatacttactaggtacatatattgttttatgtactcacgctacacttctacacttaattgtgcaggatctgaggcaggtgcatctggatatgcatccggcgcgcattcttgatctgggttcaaaattccatggtgagctgcccttccaagccgttcagcagtatgtcggagtctctcttttattttatttctgtctatctttttcggacagtagaacagacatcttttgcacattctactaagttgcccatatactaatgacactagatcttggcatgtattagtatattttggtttctgggttctgttcgtatggtatgaacatttcttcttgcttcacttattaatttaaattggtctctcgtcaaatcttttaaattaagaaaaatcactacataggaaatttgtcaaaacgggaatgtcattaagttattcgttgttggcttgcctagcaacggtactggacgccatcacgacctaatatggattgagtcgtgactccattgttctacatattatgctttgtcagctcagtaaggttccacgtgtgacatcttttttccaccattacacgggctggtttagattttttaattaccaaaccaaaccaattttatcgggttattaaatctaaataccaaatcaaaccaaaccaataaaagtcagattttttaatctcgatttttttcggggttttcgggtttccaaattttttcggttttttccccataaagtcttcatagcacaaaacataaaacttgtgctccaaatattctttaatcctagtaagaccgaactatataaggtgttcttcaataaaataacataaatatgagatgagtcatggcattatactaaaatattcaacaataaagataataaaatcgcataaaataaatattattaatcagtcataatgaaaacaaacataatttaaaattacgactaataagtactattatttacatgactaaccactaaaagaaaaataagttatacattttatctaaaccatgaaaaaactaaaaaaaaaattatccaatactatttccattcatagtacaattgaattgaatgtcttttatttgttttaatattgatttgattttgatttagaatttattcgagttacaaacatttatggactgtaaaacttattggagcatccaaaaattataagttcaagcttgttaaaagataaaactatgaaaaagcttaagaaatatttataaaatacactacaataactatttttattgtattaaatatatttaaaacttttatacatataatgtcgggttggtttgatttcggtttgactttttttagttaaaaccaaaccaaaccaaatatggtcggattttttttccaacaccaagccaaaccatagtcgggtttttttctttgtttgattcggattatcgtgttggtgcggtttatcggtcatttgtacacccctaatcaacatatactaatattaagatgaattatgaaattcatccgaacaaaaaattaaaaaaccataattaatatagccaacataataagtaaacagtacgctaaatttgagattttaattcatacatatattttattaaataataagatgtaaatgcttatacatttaatttttaagcaaactttccaaatgaaatgagtgttttaacattgtccccaggatgctcgttgacaacagccaaatagctactagttgtggctgtgacattttgtcttgcagatataaccagtttatagttaatgccattaacaacttgaaattgtccccaacacactctcaaatatcaaaggaaaactatttgatattttgttgtatgtatctacagcaaattcaccaactttcaccactttagggtcctttgcatcttgtattggctgccaattaccaagtaacgaggacggagctggaggactcgatacaggatcggacgaatccagtaactttcgaccgtcatttgcggcagacacatggcaaaagatggaagcaatgactacaattgaaagagtcacaagaaggaaagagttgattttgaaagccatttttcttttgagaagaatttgttattatattggtgtactttacactaactagtgtgggatttatttataggagaatttaaagatagtctggtcaaaaacataggtaagtttaggtaattagataataagttgattactttagaggtgggtatatgattcatagtaaattatctcctaaataatcgaggggaaaaaaggaattatttttaaataatacatgcatgtaatttggatataattacaatttttctcattaaggaaaatctgctatgattctaataattatttttctatttcatttgaattgacattattggatgattcttaatatgttattgtatttttttattatgaaaaaccagtggttagattattttccattgaatttgcttcattctcgttccccttaagagaatgtgatagcaatatgtgataagtctgaaagaagacaaaactattaccgtgaaggtatcaatggatgtggacgtggcaataaacgaaattataatcgacatcattgtgatagtgagaataataagaattctaaaatattctttcactatttgaaagtaatatttgtcatcaatttgacatgagattttgtaaagcacatatagatgattatggtccattcatgatgtgaatgtgacaacatctgatttataaatacatatttattcttggaagaatatgaacgtgctagtagtagtgagtataccacactcacctctaaaaggaggtttgagatgaaataagaaaataatttcattattatggcatgaatgatcattaatcacatacctattgtgattagctaaaatatcatggcaatgcgattatcacatgacaaaagtaatagaagcaacatatcttgcctataatgattttgaccatgaccataatggtataactttctcttgaaagagatattcaccatatggatgttgatgaatatgtggtaatacaaaattaattgagaactctgaaagagccaattattactatttttgaggaatacaattgattatcatgtcaatttattgtgttgtagtaagtctcaaagaaacataattgagtttctaaagtattcgcgaaagcgattggttatactgagattataaataaaggaaagatttaatatcttctatattacaacttgtagcaaggtaatatatatgtgaaaagctacctgcttgattctccagtttgtactacacaaataaaagaataccacaataaagtggatgcttattgatataaaaacccatatcataataaacttggagtttattgataattgcacatgtcatggtataaacctgaactttatcaagattgataatttattcagttggcataattggtttagccatatcaattcaagtatgatgtgcaaaagtaaaagagaattacacatgggtaaatattaaagaactagaaagttctttacgaattctcttatgttgcttgttctcaataattaatataccaactaaaaattgggattgaatcccatgattgctggaaatataaaaagtgatatgggctcattcacctgccatgtataccacataagatgcatctatgagatggttacatgtgcgattattattaacctgcaacctggtgtttgcgaggtaattgctcaataatttaatttaaagcataatttctaaatttctattatcaagacagttcatcttgataaattggtttacatcaagttggtttagtaaaatgatttattgagtgcctccacttaatagctaaactattgcttatgagaacaaagttatctatatcagtatgatatagatcatataccacaaggttttcatgtgttatagtccacgtcatctgcatgaattcggggaccagcccgaaatctccaaaaatttgcgcgcacataaaaatgacttagtgaacaatagtaattacttttccatgacagtcccttgttaataagcattttagggccataaaataagaattcaagacgattctcaaatttttgtatgctatagtccaagctctgtgcgtgaattcggtttgaccggacttcgaatctccaaaaatttataggtccatcaaaaacgatttaatgaacaatagtcatcgcttcgccatgatcgttcctcgatttttggcgttttagggccataaaaattaatttaggacgattcccaaatttttatatgttataatccacgccatctacatgaattcaggcgaccggcctctaaaatcctaaaattttgcgggtccatcaaaaacgacctaatgaacaatagccatcgcttcgccatgattgttccaatttttttagtgtttcagggccataaaacaataattcagaatgatttccagattttcgtgtgttatagtccatgatatatgcatgaatttgggaaaccgacaccgaatcttttaaattttgtgggcccatagaaaacgaccttataaacaatagacatcgcttcgccgtggtcattccccattttttagtgtttaaggaccataaaacaaggattcatgacgatttccacaaattcgtgtgctataatcaggctcatctgcattgaattcgggctatcggtcctgaatctcctaaaatttgcaggcctataaaaaaagacctaatgaacaattgtcatcacttcgccatgatcgttctcgtttttggcgttttagggccataaaataggaactcaagacgattctcaaattttcgtgtgctataatcgatgctatctatatgaattcggacgaccaatcctgaatctcctaaaattttgctggcccataaaaaacgacctaatgaacaatagtcattgcttcggcatgaacgttcctcgtttctggcgttttagggtcataaaataggacttcaggacgactcccatattttcgtgtgctcatgctatctgcatgaattcgggtaaccggcctcgaatctcctacaattctgcgggcccatcagttacgacctaatgaacaatagtcatcgattcgccatggttgttcaatattttttgtcgtttcaaaaccataaaacaggaatttaggacgaatccaagatttacgtgtacaatagtccatgctatcggcatgaattcgggcgatcgacccctaataacatccttaagaatgactatctgtgcacttacctccaatttatttcgttaagattcagtagactaatctaataagaatatattgggcctaatatcacagttcattagatttttgggttattcctccacggtcactgaattatattgctgaaggttatctaaagtctgaaagctacattaagttgacctaaacttcgtcatccatgtcaaaataataatagaatttcactagttgatacaaaaatagatcaatattaagttaaatagcaagcaacaaataggaaacatatgaatgaactgttatataaataaatttatacttacacttgatgttacagcaaatcatattattttttttattataattaagtaataaattgaggtgaacatacatatctagattgtagtgacataccatttcaaagtacatgagtcatgggccaaaatactttgatttcttatgtttgcaaacaagatcacaccttttcagaggttttccacctttctgttgagcaccaattggaaatccaatctgacttctaaaacggattcacagataaaaaatggcaaaaaggaaagcattcactcctctttctatcttgcatctatagtatttttgcccagtaatgcaactatgaatctcatggagagttctatcctggctcaggatgaacgctggcggcatgcttaacacatgcaagtcggacgggaagtggtgtttccagtggcggacgggtgagtaacgcgtaagaacctgcccttgggaggggaacaacagctggaaacggctgctaataccccgtaggctgaggagcaaaaggaggaatccgcccgaggaggggctcgcgtctgattagctagttggtgaggcaatagcttaccaaggcgatgatcagtagtggtccgagaggatgatcagccacgctgggactgagacacggcccagactcctacgggaggcagcagtggggaattttccgcaatgggcaaaagcctgacggagcaatgccgcgtggaggtagaaggcccacctagtgttctaaaatagtcctttattttagtcttaagaaaaaaagacgctctgttatattgaagaacagatcttaatttagacaaattaataacttgggtttgtgataatttgtaaaatacatatgcttgtgacaagtaggataaatcaaaaaaaatatgtgaatttttcttactaatattataaagtgacttttttatagtcttttcctgtatttgttcgatgagaaatgcgagtctgttttgtccactttcttcatccccctctatcaaaatgatcaaaaaatagaatccctgcctttgattacccagttgggatatagcaatttcgaatgactattgttttaaagatcattttggagatggaaggaggaaaaaagaagaaaggaactcacataatggatattttcatcgagacggaatcagaatttgaaacttgtgactctaaatttgtcatcggactcatcaggggcgaaggcacaagccgacttacgagttcggccgaattcagtaggttttgtttaaacagtgtatttggtgttttgaattcatgaaaaatgtataaatattaaatctagaattcagtcattaacacttgaagccgtggtcccaaaatccagaactcataaggttgaaatttttactccacctctaaaactcgtagctcgttttagttagttggtttgcaattttaaagttttatatacatttaataaattttctaaataaaagctattaatgctttctttcgaactcataactaacattgtagctccgcccctgctttctctagacaagtatgaggtcatgagatatctgtaaagtgttatgagattgaagtttatttgtggtcatactaaagaaatgtcaattcagaaagtagagggtctatctgccctttggggtacatcaatggactgaatttgagttttgttttgttttatacccactactacacacgtcgctgcgtcgcatagttatactttggaagtcttattaatttggtccacaaatttctctcacatgcaaataggccccacaattgtatttatggtgcatatatgttgtggacccaacaggcaacaaattaaaacatctttaaatatcaggaaaataatgaccacgtgattatattctttttccaccaaattttatgttgatattcaaacatatggcatttagatttcacaaaaatctctcaatttttttagtttcggatttttggagaatatacacagagagatttttgtctacataattataagtcttgcaacaaatttattcatcctttagtaagtactttcgggtttaaaggacagtccggtgcactaagctcccgcgagggttcagggaagggccggatcacaagaatttattgtacgcaatcttattctgtattctacaaaaggttattttcacggcttaaacccgtgacctccagatcacatggcgataactttaccagttacgccaaggttcactcctaagtactttcgggtttgagtattattttgtatgattaaaataaatgattgtttcatgtttgatagaacaatccgtcccttaaaataactaaagctggagatttactgtgattaatgaatttcatttttaagaaatctcttattagtttaggtgaaatttcaaactaaatatgccctacttgtttttattttattttatactagtttatatgtgtgtcaatattatcagataaacatcgaaggtacgatgtacacaatatatagcaatttgagataaaattttttaattatagtcaaccaaatataaaaataaaaaaattagcgaaaggaatacaaattagctagtaagccagggaaagaaggcaattagaagttgagtcctacaaaagataattttttttatacaataattctaacttactaatgataactatggatgagtcggatggataactttgtatgacatccaactactgtagtgatgcccttttaaatcatatatatatatatatatacatatatatatgtatatatatatatatacatatatatatgtatgtatgtatgttatatatatacatacatacatatatatatatacatacatacatatatatatgtatatatatatatatatatatatatatatatatatatatatatatatatataactaacaagttaaggtgatcatctctagagcagtgccggagcgaggattttcattaagggatggtcaaaatataaaaatataaactcactaagaagtcaaggggtgtcaatatatagtatatatacatttttctttaaaattatctaattacacagtataatttttcgacgaatagatgtcggtgggcaccccttgagtgcatgtggctccgtcactagttgagaggcggacctaagatttaaagattgcgggggtattctagcgaactactactcaatcagtatccctaacggacttttgatcttaaggttccaagcaaaatataccatttcaacatacacacacatatatatatatatatacttatcagaacttttgccaaaattaacagggtccgatgatcctcttcgtcaagcataggtccgcctctaatcacaccccacaaaaaaattaatatggcacaatttattatagtaatatcaatttttaggatgattatctttttcttttgcaaaacattctatttcaaaattcaaatatgtaaatagaaatgacattgcatttagttatactatgataaattgacaatgatttgacattttgaccatagtcagctctggataagaggcagccacttgttattgtctaattgaggtggccaaaattattaatcaccacatgccatgtcatatattcaattatgacgtggcaaactatataccccaagttctcgtcgtgggtcccagaggctaccccactatacttatggacgaagagttgattgagagaatggaaatgtgcaataggaaaagttaaaaaaggaaagttcctaacttttacaagcaacaaaagcttgatctacgtgtcaagtttagcttaatcatatgttaaataagtcatattatttctaacgatacttgttcttgcgtgtttaacatatacagtcaaacctctctaacttaattttaacgatacttgttcttgcgtgtttaacatatacagtcaaacctctctaacttaattttaacgatacttgttcctaatagtttaacgtttacagtcaaacctctgtgtaacagtctcgtttattctaaatatttttggatgttatagtgaagtgttgttatagagaacatatattataatatacaaaaaaattagttccgaaaaagcttgactttttatagagaagagttattatagagaggtctgactgtatataagttaaagatgtaaaaaaagttctacattatttacacaggggcggatgcacatgtattgaagcattgtcatcctatactgcttcgtcgaatttttttactatatatatgtatataatattgtgatgaaacgaataagtaagataaaacactatttgacataaattgtcttttgatacattggttatgtatttcattttgctcgaaaagataagactttcgaacctcaacttaaatttaattcagtaagttatttttttatctaaaaatataataattaaagttacaaaattataacctttttttttaccctccgtcttttttagtactctcaaattatccacccatttttctctttcgcttcttctaccctttctacctttttttttctttggtaattaaagaattttatttactaattgtaatatctagagctcaatatatatatatatatatatatattatatatatatatatacccaacagcaacagcaatatgggatacaagggccagtcatgattaaattaatagaaagcaaaaagagtagaattcattcgagagagctcttgatgatcttcaaaatagtttatataaaattctcgcgagaataaaaaattaaaataaaatctgattgagataaactcagattaacgacgattataattaacaattgatttaatcccgcatgacggcatcaaaaagaagttaattccacctcacacctttgaggtttatgtactaagaaaaatgatataacaattttggttaatagtaaaactagaattaatttaattagagtactataggaatgatcaaatgaacttgctcttttaatgttttttagttgtaaattgtaattatatatataaaaaaataccctataaaagttgctatggttatctttaaaattatctgaatttttttaaatatatgtacactaacaatgaacaaatttaaaaaaaaaaaaaagcaaaataaattttaacttctgatcttttttttccaacgttaaaagacaaaacatgtgtaactatatatatacatcgtacttcattagaattttcattgtaaacttctcaactaaacctaattttctctttcttctttcctctttgattatattattctaatcttccaaaatgaatggagatgagactaataatgaccaaaacacacctcttcttccaattcataggtcacaaagtatgaatacatttattcactcaatttttcacttaagaatttcttcactattttaggacctttattatgtataattatttgcttatttgtgaaaatgaatgatgctccggcgactagcactaatatgctcggaattcttgcttggattttcacgtggtggttgacggaggcggtgccgatgccgataacgtccatgtcgccgttgtttctcttcccgttgttcggaatttcgtcggccgacgacgttgctcattcttatatggatgatgttattgctcttgtccttgggagttttatacttgctcttgctgttgaacattataatatacacagaagattggccttaaatgtaagtaattatattcttctattcctggttgaattttgttgttttacggtcaaacctttgtataacagttttagcagacgtttggacataagaattgtaaaattcgaaaaaatgtgaaaaagatttcaagtgaaaaatggtaattgaaatttagagttatgtttggatataaatttcaatttgggttgtttttgaagttttgagagggaaaatttaaaaaaaaatacattttttcaaattttcgaaaatttccaaaatgcatcttcaagtgaatattggaaattttatgaataaacactgatttcgaaaaaaagtgaaatattttgggaaaatcttccatcaaatattatgtccaaacgggcattcttatttgttccgagatttatttgttaagtcaacctttaaaattttattctaaacatgttatatttttaatactatgtgttcctaattaaatatgtgcatacaacttttaacattgtccacgtaaatactgggtttaatgaatatggtgatcagtggcggcatttctctatctagtactccctctgtatcagtttaaattgtcatactttcttattagttcattaaaaaaatatttttataatggaaaacaatttattttttacctattttatttttaatgagaagtttttatagctacacaaatacatgaccttacaaatcatttacccttcaagtggggcggatgggttttcgtgaatccattatttttgttcaaacaatgtaaatgtattcgaaagattcactaaatatctgtaaacaattgaatataaacccagttactattaaaaatttactcaagactgttccaggaacccataaatattaaatcgtggattcatctctgtccttaaacttttaggactacatatttaaaagcttttttttttaaaattttatattaagtcaaactacataatctaaatttgaaacggagagagttgtatagttgaattattgtagacaagaattgacgtgcatgggccatgcagataacactattattctgtgggaatccattgaatccaccacttcttcttctcggaatctgtggcaccactttcttcgtcagcatgtggatgcacaacgtggcagccaccgtaatgatgatgccggtggccaccggaatcttgcaacggttgccgtcggttaaccggagccaacatgtatattccgatcagcttgtgactaacttctgtaaagcagttattttaggggttatatactctgcatcagttggaggaatgagtacattaacagggacaggtgtcaacttaatattggctggattatggaagagttattttcctcaagaaaaacctctaagttttagcacttggttcttctttggttttcctttggctttggtgattttctttgctttgtggggtattctttgcttattatattgtaggaaaggatcaagtagatctctttctgcttatttggacaaatctcatttgaaaagggagcttgatttgctaggtacttcatctaaatccttatattttatctttttaattacactcaatctcctcattaatcacagagacgtcaggatttaaagtttttgggttctgaagttacaatcgaactcatagttcgttagttactgggttcggaactaagtgtttatacatacttaatagattttctagtacaactacagagtctaaacagaaagttactaggttcgttcgaacccgtagataacaccctccctccgccgctgctccttaattaccaagtcatccttcaaattatagacatatgcgtatccaggacgaattatgtgagctgaattgaactgattattttcaatcttgaagaattatatatacctatattaaaaccagttaaaatgtatacatataactagcccatattcactttaaaatatattactattcacttcgtttcaatttatgtgaacctgtttgactggacatgaaggggctcagagtatttgtgtggttataaaagcttctcatcaagggtggaattgtaaatttaagctaaattgttttcatatttgaaagggatcattatttttgaaactgacaaaaacggaaatagattcacgtaaattggaacggagcgagtatcaatttgaattcagcttgaacttatatgtgaatgacacgtataggggtataattgtggcctatatctttaatttcaagattatatttttctgtactccaatcatttcagtggtcaattttcagatatcctaaaagaatacgtaacaacaaggtggtccaattgaaatttcgtggttattataggattatttttggccaaatattttatttctgccaataaatagatgttgaattattattttagacagattctaatggtttggacccactattgtgctgtgtaggtcccatggcctttgctgaaaagatggttttaacagtgttttcggtgcgtttactaccatttttaatatttactctttaatataatccacattattgtgtttaaatttaattatgtgactaatttaatttaattttttttctatagattttaatagtgttgtggatgacaagaagtattactgatgatattcctggatggggatccttcttcaatggtcgtgctggtgatggaactgttagtgtaagcactactctaaaatatattattacactaattacaattaacaaaataaatctatatataaacatttttcattaatctttctgaggatttcctgaataatcccagcagaatattgcttttgttttgttgattgttgttctaaaagtattggtttcttaaactaaaataaattttcttaaaataatttgatggttcctatatattacactgtattttcttgcctacaggggcgaagccaataaagaagttatgggttcatctaaaccctgtaactttctccatgtatatatatattaaaaattcacctagtaatttagacgtgatatggtaaattttctaatttgaacccaaaactttaattcctgaattttttatgcttgcctgccaagtgactacagtcctacctctctatagcagaatctttatctaacagtcatttactataaaagccaagttttctcggaaccgacttttatgttatgttataatatatatcctctataataacacttcactatagcagctaaaaaatttcggaacgaacgacagggcgaagctacattagggtaagggtggttaattgaccatccttcgtcggaaaataacactgggtatataggtaaaatattaggttttagaggtaataacatatagtgaacaccctttgtcatggatttttttttttacttcttctaagtttgaacactctaagaaacattcctggcttcgctactgacgaacgagactattctatagaggtttgactgtattacatgttgaaatttgacgttcaaaaatagttcctaaaatgtctgctcacgatattgattttttcactgcatatatataggtgatgatggcaactttactgttcataattccaaacaagaagcaaccaggagagaagctaatggattggaacaaatgcaagaaattgccatggaacataatccttctactaggagcaggttttgccatagctgatggaattaggtcaagtggacttgctgattatactaacaaaatccctagatttcttatcaaaaacaccatacttagccattgcaccatcagtttgtttaataagtgcaattctcactgagtttatcacatcaaataatgcaaccacaacagttatggttccattgctcatccagattgctcaaactatgcatattcatcctcttcttcttatgatccccggcgccattggtgcacaattcgctttcttgctccccacgtcaacgccttcgaatgttatagggtttactactggccatattgaggttaaagacatgatccaaactggattccctttgaaagtcgttggaattgctgctctctctttcttgatgcctacccttggtaaagtttcctttatatttcttagttattatatttgcattttttattgttacaatgagtaacgataaagttactttaacgtgacaaaagatagttttgtggcgttaatattatattgtacgatgaaaataaccgttttttttttttgtgtgtgtgtttcagcgcctattgtttttggaacagataaacctataaatgtatcaaggaattatttacgttggtgtggctagttctttggatagagggatgcataaggcaagaggacaccaacctttggttttgatgattttggaccaattgagaaagggttataagttataggtactggcgatgtaaaatatttatacaatcatctcgatatcatatggtgtttattattattttttttttaattttattgtatatagatgaattatgtccctcaagaaatcacgtggtacaaaaggaggaagagttcttgaatatatcatattttattatacatattcgctactttcttcttctattgtagtaattgtataggcttttgtgttccaagaaatatggaatgttaacttttgtagataaaatttaggagagtcgagatactcctaggatctttcatatttaactcgaactgtcaggtaatatcactttcagcccgcgccagaaacgtattcggtagccgaaaaaatatacacccttcgttccaatttacgtgaatctgtttgactggacacgaagtttaagaaaaaagacttttagaatttgtggtcctaaacaagtcaaaaaggggcagagtatttgtaagcttcccactaaggtagaaatgtaagtttaaactaaattgttactggaacaaatggagtataaaatttgtataattcttgtatataataaatagaatgatatatagatacaaaaaataattttttggctattattttgagagcggatgtacattatcattttcccaacttttattgacaaacaagtcctttcttcttcaactttagaaagcccaacggataaatagattttaagcccaaaggtttgggtctccatgtgtataggacttctgtctttacgagacaggcccaaaattaatggactacgagacaggcctaaatacgtggctcaatattacaccaaaaattacgtgggagaaattcaaaaatagccagagtttcaaaagtaatcaaaatttagctactttcatgtaaagataaatctgaatgaaagcactgttcaaaatccggaaaatactccagcataatatactggaactccagtatatatactggagttccagcataagtataccggagttccagcaaagtatacaggaactccaatatattatactggagttccagcaaagtataccggtccaatatattatgttggaagttcatacataggtgctcgagtctccagtatattatgctggaacttttgcgtgttggagttccaacataatatattcgaagttcatacacaagtgcaccgaactccagtatattatgctaaccggtctctgtgcagcaaaattgtagctattttttaatgacttggcaaacgctgactatttttgaatgaccagtcttaaaactggctagcacgtgctatttttacaaattatgttggatgaactaataattctggcagcgtgcttcaaacgtttggcactgtgcttcaaatttctagcaatgtgcttcgtattctggtagtgcgcttcaaacttttggtagtttgctttaaaattttggtagcgtacttaaaaattctggccgcactcttgaactacttgaacaacgagggcagagggtgctatcgtatataagaaaaactgctgtattttggcagcggttagctctctctttaactaaaaatcatactttaatgttccggtgacggaattatctttttcaaacttttcttaacggggtcaaaatataaaatgtagcactaaatgatcctatatgttcaaatctcctcaatattatattatgctattaatattatgtagaaatggtgcgagatagctactttttaatatggtatttattttttatccagtgttttcaatgctgagcaaaaatagccattactctattaaaattaatatgaaaaaatattttacctttttatcatgagtgctgtgtaaatattaaggacatggtgtctttaatatttatattgcacacatgaagttaaggatgccatgtccttaacatttacattgcactgtacacatgaagttaagaacatgatgtcctaaagtttaacaacggaaggtgcaaatacatgacaatttgtccttaatatttacacagcattcatgaagttaaggacattatgtccttaatatttaccaatactcataaagttaagggcactatgtccttaacatttacattgcacacatgaagttaaggacgtcacgtccttaacatttacactgtacatataaagttaaggacgtgaggtcctaaagtttaacaacagaaggtacaaatacaagttaaggacattatgtcattaacatttacactgctaacatgaagttaaggacgtcatgtctataacatttacactgtacatatgaagttaaggacatgatgtcctaaagttaaggacactgtacaagatccttaatatacatgaaaaactattatttatttagataatattaattgtgacttcataattttaaaagtataatgaatttaacgttaagaacttcaaactcgaaccaattaactttaaattctaaaatcacctctattaatactgacatattatatgtaatttacgtacattgtgattcaatgagtttgattattatcttaaactttagatgacaagtccaatggaagattgagctagttgtttatgagcaaatacgtcgcattaatgaaactcatgcaatatattaagatttttattcatccaaaaataaccaaaaatacaattaacacaatgtcatacccagctttcaagaatcataacattacgatatatatactagtttttctctacattcaatactaaaagtaggttgaaacaatgcctaaaaattttattttgttagaactattatggagaagaatattcactttttttatgtatcagcgaacatcatcatcaaaaaaattgtttgtttttttactagattcaagatatttagaactgtaaatagatggaagattgttaaatctaccaaatttaaaaagactaatatgtacaacttgatgggtttaaggtttcaccgtcttatgttttgatgatctaacaagcttcttgtctagaaccagataaaggacctagaatacttggtacaattcttcagcaatggacttaagctagtatgagctgtgtgactttggatacacaagaatcaattcagggacctgatcctatggtgtttctctgacagaagtacaaagtcaactctacagctggaaagtggttgcctgcaactgtgcacgctacagtgcagaaacagtgcagcagtcactttccattgggaagggccttgtaccgaccaagtgtggacatcatcctagagatgtcattgaagtataataacaaggagtatggcaacaaaaatattcacttgaacatttagtgatattctctcaagcattgaagatctcatctagcattgaagtcacaagtgtgtcaagaataaagtgcaactccattacggaccagttccattatgagtttatgtatgtccttagttgagatgtaatcttgtattagttcttcattgtaattcttatcttgcttacttagaagctctgttttaggaaactcaaaaacataaatccgctgagtttgtgttgtgattagagttagtcataggttgaagtctttataatagagtcactacaacgtggcttgtagtaggtgtattacaagttagtgaggttgaagcctttgtagtagagtcattacaaagtggcttataacaagtgtattgcaagttagtaaagttgaaatcctacctgagtaggtcgtgatttttgtccccttgagtagggattttttcacgtaaaaatcctgtgccttatttactcactgatttattagttagtactgtgggaactgatataggaccaggtctctatacagttttgcggactcatataaactatcaattgttataagagcaggttctttctaaaaggctaacacctagaaaggatctccatggctgctccaccaagcttcgaggaaggacaatcaacctacaagcctcctatattcaatggtcagtactacgactggtggaaaactcgtatgcatgactttataatggtggaagactccaagctatgggacgtcatctgtgatggtccatatgttccgatgaagaaggtaggataaccaggagtgatggtgccgaaaaccagaaaggaatacagtgatgtcgacagaaaagctgttaaaaagaactttcgtgctaaaaagatcttggtgtgtggtataggacctgatgaatacaatagaatctcagcttgtcaaactgccaagggatatgggaagcattgcaaatggcacatgaaggaactactcaggttaaacagtccgagatcgacatgctcaccactgcgtttgagcttttcaggatgaaggatgacgaatcaatgcacgacatgcacacaagattcacttctatcataaatgagctgcattcacttggagaaattattcctagaaataagcttgtaaggaaggttcttagtgtcttacccagctcatgggagagtaaggtgaacgctattactaaagccaaagacctgcaaactttaaccatggatgagctggttgggaatctgaagacatacgagatgaagagaaagaaagatagtgaaagaagagaactaaagaaagagaagaacctggtactcaaggctgaaaacaatgactcaagtgaggaagatagtgatatggcctatctcaccaaaaaggtttcaaaaaatggttcgaagaaatggtggaataccaaagagaggcagctctagtaagccaaagaactatgatctctgtcacaagtgaggaaagccaggacacttcatcaaagactgcccacttctgaagcaggagcactacaagcacaactctgagaaagcagcaaaaggagcccggttcctgacaaacgcttcaaacgaaaaagtgcagctgacaatattataaagcaagctcttgctgcatggggagactcgtccagtgaatcagaagaagaaactgatgcaagagacaactccatgatggcagtggaaattggagcaaagaaatatgactcactgtttgcattgatggctcagtctgatgatgatgaagatgatgacaatgatgaggtaaatttcagggaagttcagaggaatctaaaatcctattctcctaagaaactgatgtcattagctaatgttctcattgatgcatatcatagtcttgttaatgataaggatgcatggaccataaagttaggagatgctgaacagactagggatgacttggtagtctgtgtggtcgatttaaaggaaaccatagataatcttgaaaaggaaaaagaagctctaactggaaagatcaatagtatagaaaatgagagagataatctgatggtagtggttgttgacttgaaagaaaccatagaaaaccttagcaaagaaaagaatactctcgcagaaaaagttgcagctactgagcaagagagggatgattttttggtggtaatcgcaaacctagaggaaacaattgagggaattaaatcagaacatatgcctgtaagcattgagaaagggaaggaagtagttagtgaggcacacatcaaacttgaaaaagaattaaatgaagtgaaaactagtctatgtggtgagcttgagaaaaataggcaacttcaagcagaattagagaaagtaaaaactgatcttgagaaatctctcaagtggacctggtcctcaaatgctgttactgccatgtacttcaataatggtggaaacaggaagggaatagggttctaaagagagaaaatttcttacaaccctcacagcaagtacgtcactatacctgataactggctttttacccactgtgggaacaacgggcacttcaaggaaaattgccaggctagagttcaatttgttcagaaaaacaaagtttatgctgaaaaagtgattactaagaagggaccaggtgccacgcgcaaaaaacgtattttacctgcttgaactagaaaagctcttattcaccctttttctcattacaagggacctaaactggtttgggttcctaaatctaaaccttgatttatttgtgcagggaacagtgagaggaagcagcctacagtggatcatggacagtggatgctcgaagcacatgattggaaacaccatagattttctctcactgaaagccctgcaaggagggaatgtatcctttgaaaatggaaaaaagggatacattctcggtatcggaaaggttggaaagtctctttcacactcaattgagaacgtgtactatgtggatagtttgaagtatagtctcttgagtgtctctcaaatatgtgataaacggaacaaagtagagttcttgtctaaggtgtgcacagttactaatttagtaactggtgaagtgattctaatagccaaaagatacaaaaatatctatgttgctgattttgagtctctacaagctgatgatatgagatgcctgaaggtagttgatgatgatgcagaattgtggcatagaagattgggacattcaagcttttcccttttgaataagctgatacagaagaacctggttcgtggtctgccaaattcaaagttcaaggagcacagagtgtgtgatgcatgtcctagaggaaaacatgtgaaatcatcctttaagccaaagaaggatgtcagcacatcaaagccactcgaactccttcatatggatctttgtagtcctatgagagtaccaagcaggggtggaaagaaatatatctttgtgattgtagatgactattcaaggttcacttggacactgtttcttagaacaaaagatgagacatttaaaatatttgtggcctttgttaagaaaatccaagtgaagatggaaccgaaggtagcgtgcatcagatctgaccatggaatagaattcgacaatgccaagtttgatgagttttgtagtgaaaatgggattactcacaacttctcaactccaaggactttatagaaaaatggagttgttgaaagaaagaacagaactctcgaagacatggcacgaacaatgcttattgacagtggaattgccaaaaatttctgggcagaggcaataaacattgcatgctacttggtgaacaggtgcatgatcatatctctcttgaacaaaaccccctatgagttactcaatggtagaaggccaaagttaactcatttgagaacctttggatgcaaatgttatgtcctcaacaacggaaaggatcagcttgggaagttcgatgcaaaaagtgatgaaggaatctttctgggatactcctcccaaaacaaagcttataaagtctacaataagaggatacagtgcatggaagaaagtgttcatgtgataatcaatgagacacctccatctggcaaggaaggaaacagggacgatcaagacaatgaaccattattggttcctggggagatcactgatgtttcaaatggaaaagaggatataatgagccacatgaaggaagcaagtgaagacaatgcaaccttctcttccacttctcaagagggacctggtacccaatcactaccactgaagctgaagaaagagttgtagatgcagttcaaagcactccacatgtagcaaaacgaggagtgcagcgaaaccattctgatttacctagttcttctaccaatcagactccagtcccaaattagaaacataaaatctcccatccacttgataaatcacccccatgattcatgagtacagacaagattaaaaaccagaaattccccagccttctcagcctttctatcccaaatagaacccaaaaatatcaaagaagccttgaaggatgcagactggatcacggctatgcaagaggagttgcatcaatttgaaagaaacaaggtgtggcacctggtacctagaccctcaaatagaaccatcatagggaccaggtgggtattcagaaataagctggatgaacgtggaaacactacaaggaacaaagcaaggcttgttgtccaaggctacattcaggaggaagggatcgattatgatgagacctttgccccagttgctcgcatggaagccattaggattctcattgcctttgcatcccatatggaattcaccttgttccaaatagatgtgaagagtgcctttttgaatggttttcttaaggaagaggtttatgtcaagcaacctccagtctttgaatgtgatgaacatcctaagtacgtattcaaattggataaggcactctacagattgaagcaggcccctcgagcttggtatgaaaggctatccaagtttctcttggaaaatggattcacaagaggaaaaattgacattgctcttgtttttgaagaaacggggaaggaacctgctcatcgttcaggtatatgttgatgatatcatatttggagtaacgtagattcactgtgtgaagaatttgctaaactcatgggaagtgagtttgaaatgagtatgatgggggagctaaacttcttcttgcgccttcaagtaaaacagtccacaaagggaacatgcatccgtcagcagaaatacatcaaggaacttctaaagaggtttgatatggaagcatcaaaggtgattaatactcccattgctacttccactaagctggatatggatgaatatggatcacctgttaaccaaacaatgttcgaggaatcattggatcactgctctaccttactgccagcaggccagacattatgttcaatgtgggcctatgtgcaaggttccaatcaaatactaagaaatctcacctgaaggctgccaagcgaattctgagatatcttaagggcacacaggacctggttctgtattactcttcaggtgacaatttcaatcttattagttatgctgatgctaactatgcaggttatatggtggataggaaaagcacatatggaatggctcatttcctaggatcatgtctgatctcatatggtacaaggaagcaaaactcagtagctctctcaatagctgaagcataatatgttgttgcagcttcgtcttgtgctcagctactgtggattaaacaacaattggaggactttggagtatgcactgactgtgtaccgcttccatgtgagaacaccagtgctctcaatatagcaaagaacccggttcagcacaagagaaccaagcacattgacgtcaggcatcattttctcagagacaatgtggaaaaggggcttatctatatgaggttctgctgcccagaagatcaaattgcagatatattcatcaaagctttaagcagggaatactttaagagaaataggatggcactggggttaatcaaacctaattgagaacctgattcttttcctatgtctatgaaagtcatattcaagtaaaattagctaaagtgttttctgaccaagcctaactcacatctataccgttacacgtagacacgcatgatgatcatagaagctgaaagagagttgcaaaaatcttttgacaaaaatggtcaggaacccggttcctacaacacaggttagtagtaatgtgtttttctcatacatatctcaaaggacaacaaaattaattcaactgccacatcattcgacttttcagaacctgtatatcatgtctcatctcccaaatcctttcacctttactgcatgttacgtattcctacaaacctaccgttgtttcataaccctttagaacccgttcctctcccctctcttttttagctcctccttccataaaacccgctcacttcttgaattctgaacaatcacttctcattgtatctctcccttctctcagaactctcaaacccttcttcaccatggccgatgaacaaccttccctcactcttgtaaatgacactattaccacatctccgactcccttagcatcaccactagaaacactttcctctactacccttgataccaatgtatctacacctatttcttcttcatctcctgtctctcttacacctccgtccaacattgtttcgctcccaagtgctgaaacttctgacgtcccagacgttaaccatgtttctcctcctccttctaatcaaaacaagggggaattggaaggtgctacccctcaagagtcaggagtctctgaggaagatcgtgatcagtacttgaactcctccgtcttggactcaatggctcccatggagtcaccggaaaaagaggccgtagaaaataatggctatcgctgctgaaagctttacaagtgaaggaccctctcttctgcctgagtctcagggagaaaaaactctatttttaggggatgaaggaaccatggtacttttagaatctcctgttcatgaaagaccacaaaaaaacctgttggagaacatgattcccttcctgaggaaacaggtcaggagcccatcttctatactaagccgttggagtccattcctcctattgcggtaccttttgacgaggatgacatggttcttagtgctcgtttcaaaataagaaagccagtagtcactcctgagccctcttccaagcgaccaactactaggttgcagaagaagaaggattttgagtctgctttacagaaaactagaaggagcagcaagaaaagaagaagagactaatgaaagcgggggaagttgtgtatgccaaaaatgttccagtggtggaagttgatgaggatgatgtagaggaacctagttccttggtgaagcagtctaagaaagtacaaaaatctgtaactggtgcttccaaggaagctgtggaaaaaatagagtggaaatctgtaaagagtgatggtcagtctaaaagggttgtggaggaggaaaatatgtctgagggtgatgctttggttgctttgagtgaaaagagaagtatgtggcaaaatctagaaaaaggaagtgggaaactgttggaggacctagttctaagaagatgataccaagtgaaagtgggcttgggcaagaaagattgaggagtcagaaagtcttgtggggtcatatgtttgacccagaaatctcggagatggcaggaatgagacaagttttggagatggtcgagtttcaacaatggggtaatttgtttaaggggatgtgcctaaggtttatgaagatgaggtgcaaagcttttatgcaagccttttcaccattgcgggggtccatatttgcgtgctagtcaattgggtcgacatggtgatttatgcaacctttgatgtttgtggcagttgtttcttcttttttttttattttttgtggtggtatgttggatctcactgttgctgctcccccctgaatcagtccaaactagactttgttgtaattgcaaaggcttatatttttaaaaatattttcaatgaaacaactatctttttgctagtgaaatgcttgtctttcttctgcttttcttttctatcatgttgtatgcacacatgtggtatgagttagctgtgttagacttctttatacttttttgcctgcttgtgtacttttagtgatgccaaaaaagggaagatctagagataacttgaaaactgaagcaggtgattaagggggaagcatagagtcatggggaacatgtgatgttcctggtactttatctggttaattcaagctctataaacggttgtcaattccaaaagtttgtcatcatcaaaaggggggaaattgatgggcttaaggtttcaccatcttatgttttgataatctaacaaacttcttgtctagaaacagataaaggaccttatgcatacttggtacaattcttcagcaatggacttaagctagtatgagttgtgtgactttggatacacaagaaccaattcagggacctgatcctctagtgtttctctgacagaagtacaaagtcaactctacagctggaaagtgactgcctgcaactatgcacactacagtgcagaacagtgcaacagtcacttcccattgggaagtgctttgtaccaaccaagtgtggacatcatcctagtgatgtccttgaattataataacaaggagtatggcaacaaaaacattcacttgaacatttagtgatattctctcaagcattaaagtcacaagtgtgtcaagaacaaagtgcaactccactaaggaaccagttccattatgagtttatgtatgtccttagttgagttgtaatcttgtattagttcttcattgtaattcctatcttgcttacttagaagctctgttttaggaaactcaaaaacataaaaccgctgagtttgtgttgtgactagagttagtcataggttgaagtctttgtaatagagtcattacaacgcggcttgtagtaggagtattacaagttagttaggctgaagtctttgtagtagagtcattacaaagtggcttgtaacaagtgtattgcaagttagtgaagttgaaatcctacctgagtaggtcgtgattattgtccccttcagttggaatttttccacgtaaaaatcctgtgccttatttactcactgatttattagttagtactgtgggaactgatataggaccagatctctatacagtttgacggactcatataaactatcacaaatactaaaagtttttcattaaaataaaagttatactagattacattgcaattatagaaataacaaaataccagggaaaagaattaatagctatactagatcatatcatgatgacaggaaaaaaattaaatatctctctagattggattactatattgaaaaataataaaagaaaagaaaattttaaaagatattttgtatcagattgcaaaatcaaaaataaaagaaaatttatattagatcggatcacaataacggaatataattgaaattttttcagaaaaaaaacactactaaagttatactggatcggattccaatatctggaaaagtatattgagtttttttgctattaagttttaatccctcaaatattgacaaattataatttggtcattgtgatttatggttaagcaaattaagcacatttttgagctcttgcttgtggatctttacaaatattacgaactgttaaacaatttaataactggtatattgttatgaaacaataaaataaaaagaacaatattgcagagaaagagagagagtaaattcttattgaattttgggataaattacaatggaattgaacccctctatttatagggaaaaagtgacttaaccaccaagtaaaattgggaaaaaaaattctagaaaaggaaaaagagtacacatgtttagaaatatgcttctttgattgccttgttaaaaccttgcaaggaaaatccagtgggacaaaactttgtaaaggaaaaagagtacaacgcgtattagctccccctgatgagagcatcaattcacattcttgagccttcgcattttaattttgtacactagcttcttgaaggttgacatcagtagagatttgatgaataaatcatgcatattaacttcaatgaatatgttgcgccttgaaaatcctcgttgtcacattatcatgcttatagagaattgataattcatttcacgtaaacttttctcaaatgtttatcatctctccctttcatattagaaaaactaacttgcttcctcaactttggaaacccatctttctgcattatgctgttaatcaaaatatgcactgcacatcaataataataagatgaaattatttagttcctgaccctgaaccacttgtgaggggagaatttaatatacttttgtatataacttgtatcaaactgatatagataactttgttctctaagctagcttattaagtggaggcactcaataaatcttttgctaaaccaatttatcaagatgaactatcttgaataaaaaattgaaattatgctctaaattaaattatgagcaagttacctcgcaaacaccatgttcaggttaataataatcgcactgtaaccattcatagatgcatctttatggtatacatggcaggtgaatggcccaattcacctttgatatttccagcattcatggattcaatcccaattttagttggtctataattaatgagacaagcaacataagagaattcataaagaactttcagttctttaatatttacccatgtgaattctcttttatttttgcacatatcttaaattaacatgtaaaccaattatgcaactgaataaattatcaatattgataaagttcaagtttacaccatgacgtgtgcaattatcaataaactccaagtttattatgatatgggtttttatatcaataaacatccactttattgtggtattcttttatttgtgtagtacaaactgagaataaaagggaagcttttcacatacaattatcccgctacaattgtagtaatagaatatattaaatctttctttattttagttcaatataaacaatcgctttcgcgaatactttagaaactcaataagtttctttgagacttactacaacacaataaattgacatgataatcaattgtatttctccaaaatagtaataattggctcttccagagctctcaattaatttggtactacccatattcatcaacatccatatggtaaatatctctttaaaagataaaattataccattatagtcatggtcaaaattatatgcaagatctgtttcttgcattaatgttattatttaataatcacattaccaaaatattttggcataattacaataggtacgtgatcaatgaccattcatgccataataatgaaattatttttttatttcatctcaaacctccttttaagaggtgagtgtgtattcactaccactagcacgttcatattcttccaagaatgaatatgtattcatacatcagatggagtcacattcacatcatgaatggaccataatcatctatatgtgctttacaaaatctcatatcaaatcgatgacaaatattgctttcacaaagtgaaggattattttgagaatctttattgttctcgttatcacaatgatgacgattataatttcgtctattgccacgtccatatccattgataccttcatagtaataattttgacttctttcagacttataccatactgctatcacattctcttaagggaatgagaatggagcaaattcaatggggcgaattttcaattatttgcccacaatcatacatgaatttgatcatgacaaggcataaaaattttaccactttgggtggttataatttctcaaactccattagagttacaatcaaaatttatcgtctttacttgtatttaaaatcaaattatagaatttcaagaatttaaaagagaaaaataaagtaaaatacttaccttaaatccataatttaatcatgaaggaagttcatgtaacaattgacgatcattatgctcaatcccaaagcttctactcaattggttagagtctcgtgctgataacgtgttatgaaacaataaaagaagaagaataatattgcgagaaagagagagagtaaattcttattgaattttgggatgaattacaatggaatagaaggaaaaagtgacttaaccaccaagtaaaatccctaaaatctatctaaaatatagacattcactttaaatataattctattataacatatattatgttctataaatacacattattattaattggagtttaaacatgcctattacttggaccaaatttagaatatattaataattaaaggaccaaaagtgtaattgaaattctgaaatcaaacgtaacagaaaatacaaatactcctctttcccctctcttttcacactctaacagtgtttctctgttttttctgcgacactcttcagtcttctccatttcaaccaaattaagcttatctaccgatttctctgcaatttaggtttcagaatttattttatttttaatttagttatttatgggcttaaacaacaacaacaaacgtaagctcaatgatttcgccgccgatcaagtagaattctcagtcccttccgccgtcatgatgcgaaaagaccaaaatctccctccaaagcatattcagttttttgtccggttgtttcccggcggcaaaacgctggtaattcaagctgattctaatgactcagtagaatcagttcacgaaaaaatcatgttgatcaccggtataccggcggtggagcagcggttaatttaccggggaaagcagcttcatcagtgggatcaaacgttatcggattgtggtattcaaaaggatgctagcttggaacttgtaggccgaatgcggagcacaggccatcctaaggcgtggcggcttatcaatgacttaatttcactaatctccggtattttgaaaggcaattatccttctgttaattcgaactcgtatcatataataaagatgcttatacagtttttaactatgactccgaaggatagtactgaaaaagcgtatgaacacttccaaatattcatttcctcgtctgctcctgcagctctggtaatgctttatatgtcttcaaattatgctaacaaaaatagtgctaatgaatccgttcgttcatttattgattcgtttaagagtatgttgcctgtacctgtgtacaatggatgtttcctatagtgttggagttctgtaagcttctcagaggagccgttgggattgatgatcatttgtataataaatgtcggagtagtttaggggctatagtagagtccactgggatcgcgaggtgcaaggctgaaactaagaagttgtttgcattgcaagatttttttccgtttgttcgtgaggtagcaagtaagttatcttatgatttagaattaacaatgggatcaactaagcttataggtttatcatttagcattgtgcatgattttactgtgtttatgcttccggtgaagaatgtaatacggtggcaagtaccgtttcgctttcctataactttcccgttgaaagaggatgacactagtgaaggagtgtattacaaagagtatattgaatgtttgcatcatattttctatgatttgctagataaaatggagatgtgtttaagggaattggaagaccagttgggtttgaaagagaaaggaaaaggcaaacctattgcaccctggtggtctcagtatcttgtaattctgaaggagttaaatagtatatcaaaactgtataagggcttggagaaggtattttggcagaagatgaggaaagtaaggctttcattgtgctttttgatagtttcatttgcgaaaaagtctgatgattatgggtgggttcttgagcacaaggaggtaaccaattttgagttgaggaggcatttggcaatgatgatgcttccggaagttagagatgaaaacgaggagctgcatgagatgctcattgacaggtcccggttgttggaagaatcattcgagtacattggacaagctgattccaaattgctacgaggcggtttatttatggaattcaaacatgaagaagctactggtcctggtgtattgagagagtggtttttattggtatgtcaagcgatcttcaaccctcaaaatgctctctatgttgcttgcccaaatgatcgtagaaggttttttccaaatccaggtaagcttttagtgcctttatgtacacatttttttgcattttattctcacttgaactcataaaactccagatttttgctagtattagtatctaaattcttttagtatgaaacagaggataattttgtgtggatattccataaggttggttgatgtggttgctcgttgctagtctcattattcaatttttcctgaaacctgtgtccttgcagcatctcttcttgttaaaatgattttgtatcttttcctgtttggcagagaactgtttgatttcacttgctttatgacccttggatccaacctcttgttatattcaaataatagataaccaaattggaacatgttttccacaaggaaaaaattatgaaggaactggtagctaagaattcatgtttatcatggtatacgacataataatctaaagaataattaagatctaaaagggggtttactcctatttttttgcctgtaagcttccaataatccatactgacttctagtttggttgtgtacactccccccaatctaaccagtgcaaacacactcttgcaatctcaacaatctctaagctaatgttgaaagtacttttgatccttgagatgttgtaattttgactttggccccataaaacatgaagtcgtgctttggctatcatttgtccaattatttaatgcatctaggaaaagtaatattactctccgtattagaatgtaaataacgctcatctatgatttatgcttgcagcatctaaggtggacccattacaccgtgagtatttccgcttctctggtaggatgattgcactggctttaatgcataaaattcaaataggtgttgtgcttggtcgtgtgttctttttgctattggctggaaagaatatttcattggaagatattagcgatgcagatccatacttatacagtagctgcaagcagatactggagatggatccagagatggtggatgaagatacactaggcttgacatttgtttgtgaaattgaggagttggggtccaggaaagtggttgagctttgtcccaatgggaaagatactgttgtgaacagtaagaataggataaagtatgttaatcttcttattcgacatcattttgtctcatcaattactgagcaggtagcacaattttctagaggttttgctgatataactacctcaaggctccaaaagtccttttttcggtgtttaaatcttgaagatcttgatttgatgcttgatgaagtggaagtggaagtgctgtttctttggaagattggaaagcacatacagattaccatggctacaaagaaagtgatcctcaaatatcatggttctggaaggtacatgattcttatctgctagtcactatgttttcataatctttggtacttgacaattttatgctttcattccctctttcttcattatttgtagaagcagtaaatttctgactcagaaacttttttttcaaagttattgcactggggaagcatttgttttgggagtttgggtggttcatattggtttttttactttaccagattctctactggtagcaaatgtttagccggaataacatctaataaagaaagaacattataaacgggatttattgtactcatataccttctttatttgcccatcttccacaacattttcttaagtgcgtcatatggttttttttaaaaaccgcacccagcaattcatattagtaatcctgcggcatacggttattttttctcatcaatatcacactttgaataccaactccgattattcagactaagatgaaacaaacagtccttttctatttgtcttagaagctagagctttataagtcagaaaaagaaaaaggaagagttgaattgagagaattggcagaaagcaggagaacagaaaggatgtctttggttacaccaatgctaggatatatagcagggggaagaattgctttgttgagtgaggctgttactttgtcgatagggacacggatagagcaatatttagagtacacttctaggcctgttgctaccctgcctcacacctatgtcctcattctagccaaaattggaaatgatcacgttgggtgcagtggttctatgaaggcatctggaaggcctaaacggagaataatatgtttttcgtgtgtaggaactatcagggtaagcaactatggaaggctcttggtctagtgagtttgcagtctttcttttggtttccctagagctggttatggtgtactttcgtgtcattggtcatgctaaagaattcttggattgaggcctgctggctgtgttttatgatattacacacaaataatttagtgtcaaaagttagtctttgtctgctaattagtagcttgattttatggtttcttatagtggataatgtaagtttgagctgcccttgcacacctgcttgagctactcttttaccatttgtcagtcttgtgtctcggtatttgctgttcgtggatgtcacggtgcaataagctacgcgagtatcttcctagtcccttctctttcaggcttctgtttttatgcacttttactgtacaacagagagataggtagattttttgtgttaggaaagataagattctcaatgaaataggattcacgattacactaaatatcaagacacaattactctctcttttcttatttacattcccaagatagttaggtggttttcggatatggatcccaggtaattgattattgcgaactggaattagttgttgccactctgaatattgtaaggacaaacctccaagtgttaggagatgtgattcataccaataacatttgtttctttccttccatgcagatagttgcgagtatgcctgctgagcagagaaaggtgctccttttcttctggacttcaatcaagcatctgcctctagagggttttggtggtttagcttctagactttacatctacaaaacctcggagtcgtatgatcacttgccttctgcgaaaacatgcttctaccgcatatgctttcctccttataaatccatggccatcatgcaagatcggctccgcataatcacccaagagcatgttggttgcagctttggtacccggtgacatatgcaaattttgggattgaacttgcacataagatatgtaatcagcttgtacatgtaggatatgcctacctggtacctatttgaaactcgacttttttatcgtcctctttttgttaccctctctgcatggctgatggtcgtctctttcgactcaatgtaacagactgacgagtctaagacaagttagaatagctaatagaacttggcttacttctactgaatgaagaaaaagttccagtccttcttccttctctatgcatgatcatcttcgttcctttttttttttttctccctattaatggtgtttacatggctgaatacccccccccccccacacacacatcaaccatttgtagatgtcttactcgaaaaatttgtgcactaggaaacctttcattctcgttgatttgcgccttgtcattctgtaattgttgtcaacttttgtgttgtgcatatattcattatcatttgtgttagaagggataagattgtggaatgagacatcaggtggagccaaaatttgaaacttgtgggttcagtattctaattcttttaagttaattgggttcttaatcaacaatttgtatataattcaataattttttaagacaaatacagggtttggacaaaagttactaaccgaatggtatccgaagggcggactccgcccctctatgtttcgccaatcaggctcaaaatgtcaagaattgatgcaaggttggaccttagtgtatggtttcttttggtagctatctttatggatctttaaggaagttttgattaggaaatagagggattatcgactcttcttttcatctgcaacttgtcaaattattgcttgtaaaattctatatttattatctcatatgctttttctcttccgttgctctttttttttgaaagggttacgacggccttccttatatattcttgcttgattaaaagtatatgaaatacgaaactatagctttgctgactttatgagatctaattttcatcccctatttggttggcatgcaacagccttcttgattgtgttttaacagtaaaaaaattcaattttgataatcagaaagctaacatcaagagaaaaatgaaggatcattaacccattaataaaaacaacaaaaaaagatattgaccttttattataataaaaaactagagatcaaatctcatatcatcttaatcaaaccatagcaaactgaaccctggacaagataacaaacatagccaaaaaaactatgcatcatcccacccgaccacctagacctaggcatatgctaaaaacaacatataccctcactgtaaccataataatatagtagtaaataaaatactaagaaacagaatagacacaaccaactttaataagacccccatcattcaccaaccattgaactatttcccatcttcactataattcttcagaatttactcttcagctttctccacctggaactgctttctcttcaacagattctgctgctgctactggttcctcagctgctgcatctgtggttccctcagccactgtttcttcagttgctggagctggttcatctcctacagggacagctttctctgtttctggttcgtcaacaggagctgcttcgagttcagcctccgcgtggggctgcaacctcttcaacaggagccgcaactggttcctcagttgctggctcctttgtttcttgtggctgcaggttctgctgcagccacgggttcttcagcaccagcagcaaggactgcttcctcagcgggagcagtctcttctactgctgctgattcgacaatggattcactttctacaactgtgggttggttcctctactttggtttcctctagggttgtttgaacctcaacctcagctggagtagtctctactgctgctactggtgcagattcaaccttcagaaaaatttgaaatttcaacaaaatgagtaaatgttaccctcatgttagtatgtttactttagttcctacatttactaagaatctttatatccgatcaccgatttatacgacagtagaaaatataaagaacttaaatgaagtgacatagtcaataacgattcatatagctgatcctaacttgcttagggttgccgtatcgtagtaattatgttgttttgaattcttgatatcaaaactatggtcataaaaaactctgatcaagatatttcattataaaatctttatccaagaatgatctaataatattttcaagatataacaagtattgatcaaccattagattttattcacttcatcagattgtgtaaaagtaaatcttgaaaaggcactgatcagttgaagaaatgaagaaaaaaaattgcaaaaaaaattatttactataaatgtacctcaacgctggccattggaaattgaaagaataaagttgaaactaagaatggaagagaagaaaaataaataaaatggaaggatcttaggaaataaaggtggccaaagtgtttctaatttgtgattggtgatgaaaaaggatcaaatgagagagctatatatagagaaataaaatagactgtattaattaaaataatgggaaaaaaaaaaagaatcttgagggatatacaaattgacatctcacatcactgacaataaaagggtgtcaaaaaaaattaggatatctagttgtaaatgtatttactttactttacgtttaaaggtcagtccggtgtactaaacacacccgtgaactcctggtcacgtgcagcaactttatcagttacgcgaaggctctcattcactgtactttacgcttaaaagaaaattaatactaaaacaataataactacgtttcaaccccgagcaaaatagggttggttatataaacccaaatgtattgtgctttttaaagatacattataaattaattaatttcatgttgattgtcgacctatggcaattcttctcatttattcaagaaatcgagtttgggacataatatgaataagttcatataaacaacaattacaccttaatctcaaataggttagggtcggtccaacttatcgtaactctcttccttatctgagcttgaaaaccgacaatataagcaagctcacaccgaccagcaatgtgagattttccaacacaaccttttcttctttatttttttctaattgattttcaagatgaggagcttttttcttggtaagattatttattaattcatttattaatttgtctaaagtcatttgttttgattagaaaatggcaaagtcacatggtggtggaggccatttcctataaacagctatgatatcttttttcttgagtggtttcttctgtgttttgtgcagtagggcacgtaggtgactaagactatcatgctttcatgttctaattatttttaaaaaataataattttctttttctgttcaaatttatttattttttaattactttttcttaattatagatctttacaacaaaatctcttggtttaaggaatgaatctaattgctaattcatgcaaatactcataaaaaatggctcagcttattttaatttaattttaatatatgtatttattggatcttgtaaactattgatactacattactttatctatctatattattataaaaacaacaatttatgctaaatattgaacaactaaaatatccctgaaatattgatcgacttttatgcccttagaatttgtataatttaaagatctaattgtaaattatatatggaattcttttccaatttaaactatacataaagttgattttatttggattagaaaagcacatctataatttctttctaaaaaaatttgttgttcctaattacaataaaatacgtaatttttggaaaaatataagattcctactttgatagctttctttctttcttatatacattagaaattttaagaattttttttatctttttattgtgtaaggaacttcatataaattacgtatataaactttgtatattaaatacgtatatattctgttgcaattaattttagaatattgtgcaattgaaagtttattattttttttacgcgtttcataatatttgacataagatatttgtgcatcgcacgaacgtagagactagtaatacaaattaccaccaagatttcgtcaaagtaatgacagattaaatacatcactagttactaaattaaacatttatggaaagaaaaatgaaaagtttttagtgtgaataagcttttagttttttatattaacacgagaatacgaaatattcaacttgacaatatttacgccctctatttcattttatgccgtattattttctaattaatccgtttaaaaaagatagatttttacatttaaaataaatttaactttatatttttatttaccactaataagaagttcttatcgtcacacaaatattataatatggtcaagacacaagttttaaaattactttttttctttcttaaactttgtaacgagtccaactatgtcacataatttcaaactatcaatactaagtaatgagaaccgggagcagaactagagtattagatacgtgttcgaacaaaactattaatatttattaaatatatataaatatttgaatgtaagttcagtaattaaaattagctgtgagttcgatgagaagtttagaactcataaattttaaatattgactcgtgacactgtatttaaattatgtttttttctgtcggcatggaacaatttttatttacagtaaaatatattgtgcataaaataagatttcaccagatatttaccttagctagtaatgttgagtaaaatgttttttaccagagtggtcaaagatgagaatgtttagaaatttgaaaaaaatagccaacttgattttctttttgattttggacaaatggatatgaacgtaaaggccaaaataatagtgaagggccggtgccgaattggaccccactatcacaaaatacgatcataaaacgtccaaatgggtcccacaccacagcagaaatctgacgtggcacattctttttcgagcgtaaaattcaaaaatagcaagatttacgagtgataattgaaaaatagcaataattttaactttcaaaagtaattgaaatttagccattttttttaaaaataattttgaactaaaatattgttcaaaatctaaaaatattccaactaatatacaggagttcgaatttttagtgaacttctaacataatatacaggagttacaacatactatattggtccaacataatatgccgaaagctcatacacatgtgtttcaatctctagtatattatgctggaatttttcgtgtgttggtgttccagtataatatgctgaaagttcatacgtaggtccagtatattatgatggaactttacgtgtagcagcaaaattataataattttttagtgcctttgcaaatgctgactatttttcaattaccactcaaaaaactgactaacccgtgctattttcatcaattcatcccacgtacttttgggctttctctgaatgggccctactttaatatgtttaaatagggcattgtgggaccatacctaagccttgagatgctttccaggtactacacctcgtgctacttgggtcccactagcatgccctctctgattttgccacgctggagttgtgtcatccgccactctatcgccgattgtaattaagtagcaaatactcctattttcagtttatgtgaacctatttctttttgattcgtttaaaaaagaataatttttttaaaatttaaaaatagtttaacttaaacttacgattctacccttaatgagacgctttttaacttgtttagaaccacaaattccaaaaatttttattttttcttaagcttcgtgcccaatcaaacaggttcacataaattgaaacagaaggagtagtttttcgaacgaaaatatctgtaaaaaactgacgaattttaagaggaaagtagtatcgtaagcaaacaagccataacagacttcacggatttgtcccttggactacgttaacattgagcttaaacgcaggtatcatgtaaactagtattatgcttatatgtaattcgcctaatatatcgtacattttcttcataagcttgtcagcttagaagcctgtcaattctttttctttgatcccacctcgtcgacctgcctttcgtcatggacgtcacacgaatccaataagcgttcactaaaagtgaaattctttaagtttaaactttatttattagtataaggcgaaatggactcgtgggcacttaaacttgtacgagattttaaagccgagacacgaatttacatcgttcccatttgaacactcaaactcacatatttactaactaataaacatatttgaccgttgaccatgcacatatggcaatgacagaagtgatgtggacaaagtgtgtgcaagtcacgtaaattaagcgcgtgactacaataattttgattaaaaaatgtaaaatcaaaagaaaaaaattacaaataaaaaagaaagaaaataatccctcctccttattccctaacccctttctgtttctttcctcctttccccattaatgtctgtacctcccctcccccccccccctttcttttatttctctcccactctaatctttcccgcttctttctttttttgttccacaatccaacagtagtgaaaaataatagattttgtcaaaaaaaattgtgaatcctttctttcttattaactctcgttccctttttatatcgatctcagattgaaagacagcaagagaacaaagaaagactatcggaaaattgacgaattttggttggaaaattttacttatgcaatccgactttttgtctctgtctgatttcaccatttatattcttctttgacatagcttcgccgactcttttgttgccttgacggaattttagtaggtgacccatcgactctttgatttggggtatgaattttatgaatttcgttagaagtgaaagatagaatgaattttatggaagttcatggcggattgagttagtcaagtgatgactggaaattttccccgatgacagcgctaaaatatgtagaagaaatagtgaaagaagtaaaataagtaaagaaattttgataaattaattttaaagagggactcacaaatgacacatgtaaaataataaatggtcttagcatttgacgtgttcttctttcaggcaattgagttacacgcgggtttatttatactcaattgattaagttgagatgctaaaacgaaaaaattcaaaatttaaatatcggctttaaaatctcgtacaagtttaagtgaccacgaaaccattttgtcttagtataattatacgacaatattgttaccagaatgatgctagacatgctgacatatttctgaatagaaaaagttggcagtactatttgatattgttcttaactatgattgacatcgatacagtgcgaagagtatatatatattatatatatatataatatatatgtaaatgttttaaatttgattttagaatgtctttaagctatagttagcggcacttcttcgtcggaaaattatattatattgttaaataattttttttattttatgtatattttgttatatattgactcccttaatttttcgatgtatctaattatttatacttaaacacctctcgatgaaaattctggctccgccattacttacgcttcaatttagattacacatttcgcttacttagagttaaactgcgtgaagtttaaccaatattttaaaatattttttatcatattgacaaaagaaaaattgtaacttatagtatatctcgtatagtttgtgattatctaaattttaatttaaaattttgacttgaactaatccaatttagcttcaaagtttagtcaaactaattctcgataagcgaaatatgtcatctaaattgatatagatgaagtaataaagaaagaaagagaatatacatctcgaattagagtgcacaaagcatagtcaagaatgtattaattagtataatacctatccctaatctataaactaaagttattttatgacttttggttgatttagattgcttaaagccattattatatgatttgtcaatttacatacaccttaattttatgaaatattaaaaatatatatatttatttaaatatgatactagtcaagattctttccgataagaagcttagctgtattattatgtacaatacatgttactctgtaaaggtataaaaagatagaaagaattactgataataattttttatttttgccaattaaatatatacaaataagggatccatttaagaaatttaatatattgactgtggcaaaaccaagttggtatattacacgtaaattatttaaagataggatataaagtgtgatggctcttgtgtttggctactttccactataataattttatatgtaatcttcttatattgatactttttaagtgtgatatcatagaaatcggaattttaaaggattaagctaaattttaaatttaagatattataggacttttgaaatcgtaggagtgtatcagaatttctgggaaattattctaccctaaaccctaatgtacacttatataaagagatacatattccgttgaagagggtctcaaaaatcccgtaaaattctaaggatattcagaaagggatcaaggaataaaataatatcgtgatcaatagatgttcttcggctttcatggagatcaaataatccatagagtttcgtatcatcctacgttcgagaatacgctgatctagctcttgaatcacggcgaacaattcggcggaagaatcagtggataaacaaagttgtaactcgcaatgtttatcgataaaatcactttatacttttttggttgcagttcacttttcgtatgttaaaaatttattgcaaacagatataattatataacaattcaaaagtaagtataatatgatagcataaaacttgaagtctaatttagaattatcagatcttgttagaatgttacaatcataatgttttaatcaattttattataatagagaaaagtaatttgaatatctacactattaacgtgttagtactgctgaaaaaaacatactcacatgactttttgtccacctctatatagtaagttatttttttttattttccacccgataactataataagattgtatatttgtatacagtcaaatctttctataataatctcgtttgttcataatatttttacatattatagcgaaatgtcgttataaaatatatatatatatatattataatataacataaaaatttatttcgaaaaaactttaacttttataataaagtattgttatataggaataacccgtcaattctgtcaaactcgtatttttcctctttgtttctttttgttttgctgcgacaaacttgcgtgacgtgtgtttcttcttttttgcttttgatttctttcgtattattatttttcttttttttggacacatttcattatatccttttcaataatggtgcattcctcatttcttcttcctccaaaacacttgacaatcttggtattcctcacctcatttatttattttttttatttcgtcattctattgataacatagaaaattagataaaattttccaccatatatacagtgacaaaattagaaatttttttaagggtattcaaatttaaaataaatgaaaaaaaaatttcgactgaggatgttcaatatatgttatatacctttaaaacataatattttacttatatatacaatgtaattttccgacgaagggcgatcaaccatgaccatgggacttcgccactgaccatatatatcactcttgttatttctcgctttcaattctaggcaaaggtgtaaaagaaattacacaatttgattatttacaagataattacaggcattctttagtataagaattaatttataaacttaatagagtaataagtaacacgctataatcggttaaattataatatatgttctctataatagcacctcgtcataacaaccaaaagtatccggaacaaacgaggttgttatagaaaagtttgactgtatatataaaataaatttttaatttaactaaacagtgtactttccgaccaaaaggatgtcaatacccattagcataaggtgactccgccacttttcttgacgtataagttacacgtaaacaactgtactattaattttaaggcttctctgaagagcaactttacaattacaaaggcaaaaaggaacaaaacattgagacaacatttatattataaaatatattgtcaaatctaagaataaaaattcttaacttacacggtatatcctcatatagataggtagttatatacttcaaaaatgaaagatttttttttccgttaacaaacttaatttaatatggattttattgacttttcaaatataaagacagtcgaatgcataaaatattaatccttatttacaaattacatacgggatttaaaaaagggttgcattatagacacaattattagtgttgatttcacggcttgaagaactcataatttttaagttatatgataaatacagccagtgctagaatttaaagtttatatatgagtactgaaattatcattaaacttataactcatcttagttgctgaattcgtaattcaacattatatttttgtatatttaataagttttttaatcaggatttatctaaacccgtaggttataatatccctccgcccctgcatattaagacaactttattaatactccaaaaccctttcaaatataatcagctaacatcgtttataacttttgaattgttcgagtaattcagttaaatttctctataataattttgtatgtttcaaatattttttgatgctatagcgaaatgctattatcgagaatatatattccttgactttgtccgtgtcaacaaacaatttgaaatacttttattccgaaaaaacctaacttttataataaagtgttgttatataaaaatattgttataaaaatgtctgactgtacggtaaatttatgaatacgtggaagcaactccaagattgttctactttgaagaaaacattataaagactgttccttcaatttcctaaaattatggacgtcgtcgacaagaatctttaaaatatgatgattcatgttgggttcatttttcacttttaacaaaatttgcaaaaccctggtccatgttggaactcctgtctggtttctaaagtgaatttaattcttgaaaatatgaaactgtatagtcgtttttaaaataatagtagaaaaattttatatatattattataaaaaaatataaattttatatacttttatggctatcaaatataaaaatattttatattattagtgtaatttggtttgtgattgtaaattagttagtatcattcttatgaaattgctaattgatagtaattttatagaaatttacttacaattattttacaaataatatgactatgtaaatatttattgtactatcgatacgtaaaatcaaaacctttccaaagtttatttgataattttgagaaatcagaacacacagaccaaactatttgtcaatcaaaacgtcgtaaaaaggaaggacgataaaatcctaggtttcttgccttaaaagttggtcatttagatttgcaattatttcatcaattcattgactggactgtctgtcaactaactttggagggtaccaacgagggtcgtggtggagcgctaagtacactatcatccttaaccggaggttttggattcgagtcctatggtatggactcgcctttgttagggaatgttttacccataacgtgagactttccgacgtgaatccgaatctagtcggaccccaatatgagtacaggacaccaagtgcgaaaccaaaaaacaactttggagatttttttttaatctaggtttaatttccttttttaaatacaatagatgaatcttcttccttgcctttgttaagcaatatgattgagttttcgagagggtcaaagtgacggtttgacagatttaatggagtcgaaacgaaaataaaataaaattaacggattatatgggattttaaaaattaatatattatgatcattacctctctaaaaatacattatattaaaaataataaaggccaccttcttttgtggagttgctttcatgatctatatattcaatcttagctttcttatttaaccaatacacgtaatttttattgaaaattgatgtacatttaattggccgacataaatagtgatattcgatgtagcaatttttttttatcattctaattaacaagatcgcgaaatgttaataattatttcaattttaatgtaatttataattattttttcctgtaatgtttgtttaagatacctattacaaagagaatttctaatgctaagttgtcctagacaaaagcatgatataatcaactttgcgccattggcctttgaaattttctccattataataaaaataagttttattgacggatttaaaatacttgaagaataatttaggcacaagcaaaaaaaactttagcaaagattatatagaagaaatttattaaattagggagagaacgtggtaggaggctttttcacaacccgtaaactcttgaatttttctacatcatagttacctctccattatagaaattatgtagtagcatccctatttataatactacaaaatcaaaattgactagaatttagaaaacatatttccacgtgattttggttgtgaatcccaattagacataaattaagtaaactaataaataccaaatcctagataacttaggaatactaattaatcttggtttaatttccaacagcctcccttgaactaagatattcaaacttgagcatgtcatgagtaacatcaagcctcgtagaaatcaagtaccttagactctccaccaattcccttaaatatgttgcatcaacaaagtcgcgagtattattcttagttaacttcaatttctcttcaatattggctatatatgatttggctttaaccatggtaaatccctttaaaatatcatcaacatattttttctttactttgaaaacatatacttctccaactgctttgtgcgtagtcttgtacaaccaatcaattccaatttggcaatttaataggttgtagaataatatcgttaacgagcagttcatcatgctccttaagacatgcaatttcgaacaatggcacgaaattgattacatcttcaatatctataatcatgtgttgtgtttctggatcccaaactattcctgcctcaatcttgggttgattaataaaaactttctcttgatggaccatcttgcttctttcataactcggttcatcttcaatttcatcaaacaatttttcttgtgaaataccaacctcttttggactggcatcacttgcaactaaatcatcctttttcacaatcgtatggttttttgaaagatcaatttgaatattatttgacttttctttgcattcaatattatctctatcacaacaaaaattacatgtactttaacttcttttctcgtgtgtgtgtctgaattttggccttcttgatttatcttcgctggatttgatgtgtcttcgttttcttttggttgatcatccttttcttgcgatgcatcctccattttctcatctttctgttgattcaatgatttctcatatgtcaccaattcgtcttctaaatcatcaagtctgagagtgctaagatctttggtagcctcaatagttactttcttattgttaaactttaaactgagagactgcaatattttctcaactaattctaacttcttccaatacttctccattggtccttagaccattgactatttcagcaattcttgtaaagaattgtttgatagactctgttagtctcatacgagccaacttaaaatgactcctaaactcttgcagtttctccttctttatgtcagcaactcttcgatataacttcaccaaaattgtccaagcctcctttgatgactttgcatgcaaatgttttttagatacatacaattcaaccttgatggcgagatagtagtgtgccttataatctaaatgtctcttcttctccaattgcatagctgcatcacccgtcaatattttgccttctggaagttcctcaaatctttcatcaatggtggaccataatccaatagccataaaaaaattctttatttgttgataccaaattttaaaattacttttgccttcaagcacaaaaacgggacaattaggtaatagagtatccatatttttttggatctcctaccggctctgacagaatctcacacaggctctgataccaatttgaaggattgaaataccccaagaataatttaggcacaagcaaaaatttcaacaaagactataaagaagaaatttattaaactagggagagaacgtgatgggaggcttttttacaactcataaactcttgaatctctctacaacatagctacctctccactatagaaaatatgtaatagcacctctatttataatactacaaaaccaaaattgactagaatttagaaaacctatttccacatgattttggttgtgaatcctaattatacataaattaagtaaactaacaaataccaaatcctagacaacttaggaatactaattaatcttggtttaattttcaactgtcatgcttagtgggatcaaaataacatggcgcatgtgaaagctaacaaattaaggtaaagtttagtggatgataaatcaaacgacaacaaagagatttatactaaaaaggcataaaattgtaatatggtttggtcagttgacctacatataaaaacctagtataaaaataaataaaaaaattattgagagaaaaatcttctcctaaacgagactctttaatgactatattgtgaatattattgtttctcttgttgtgaaaagaacatcaaataatagaagtacaaaacttctcctccaagataagaataagacatatgaaggagatttaattcttttaaaaatatttttctcttccttcaagaaaaagaatcctaatagattaaaaattcatggcaagataataacaatggtaggcgcgaaagctatacttatctgtatctatctatttatatctatattattataaaagcatgaatacaatgtcgatttacaaaaataaccttataatattaagcataataactcatcataaaaggacataaccgaaaatctagatattaaccttattatcctattagttttagaacaatattacacgttaggaatcctacatatcctttaggaatcttattagtataattactccccggctgtctaacccgtataaaactagacaatactacacggtttattaagaggcatgttactgttagcaacaatagcaagtggtgtaccagcaatgattttattatgaggcaacccactttaaatttgccgcttcaaacaacttaaataactattacaattatatcaaagagcaatgatgctaaatttataaggaaagtaaaatttataatatgggacgaagcacttatggctaagtgtcaaacgatcgaattaattacccgggtttctagagtatattagatactaatgaaccgtttggtgaacaattaatgattttggaagtaatttatgtcaagaactagcagtagttccaaaatcgacaaaagtagagatgataaaaggtagcttgctaaagttatacttctggcctaaaatgaaaaagattcaactaacaagaaatataaagtaagaacaatccagtattcagtgtcttctggcttcgtgccggaaatgaagaagagcatccaataaaagatgatttggttcttcttgaacacttggctatcaattccaatggtaataatagttcatttaataagagatatatttctatcattagattaaaacgtaatttgtgcaaatcgtatgatacaattaagaagatatcttagctagtagaaataaatatgttgctcaactaaataacaggttgattgcaaaattatatagtaaaaacaaaatatttttctatttttgactcattaaaatatgataccaataattactaccaggaagaatacttaaatactttaataccaaatggccttcaatgattatcttgtcaagtttattatttcttatgtatgttagtgtcaccgtatatatagtagagtaagttgaaattgatcttccattgtatataggttgactttgaagaaaattatgtctgttatgctacagaaaatttaaatacgtcgaatagcttatgtaataacacacatatggtaaattgaagttttgataataacgtcatatatgatattgatcaatgtgcttctgagtatattcttatccctgaattcaattttcgtctttcgaaactaagcaatttccttttaaatatgtgtggaaataattttaatatgtttatgttttgcaaaaataataaataaagcacaaggacaaacgtcctaaatactggactatatttaccgcaatatgttttcttgcacgaacaattatatgttgcactttcaagagggatatcaagatccacaataagatttctggttaaagcagaggcatacacaaaaagaaaatattgtctacaaagaagtgttcgctaagataccatcacattaaatacttttaaactgtaatacataattatctaactaacatgacaaaattgatcatttgtgtatgttttgatgatgtctttttattttaaatttatttattatgccaatataataatattttcgacatttaaatgactgttgtattattatacataaaatttctgtcattaattatattttattgttccttcatataagtaaatatttaaattatcatgtgtcattattaacgtgtaacgcacgttcacatatactaatgaggtaaaatattgatgtatatgtttaaggcaggaaattgtaatgcatgagtacttttatagaaatatactagtttggtccaaaattattgtaattatagatcatttaatattggacagcctccggtgcataaagtattttatatttatacgggattcagaaaaagaccgcacccaattaaaaaaataaagaaaataaggaatttgattcaaaaagttaaaaagagtgagtaataaactaataaaaagactgaaaaaaagtataatataaatagcctatcctaataatttaatattgtttaccaaaatatacagttgtctgatatatataatgtttagatagattctattgttttcaaccgttttatgatgtcatgcacaaacaataaaagagtaaagttgcaattttataaagaaaaagtaaggtacgagggtttatataaaaaggtagggtaaagaatgaaataagattatataataatatgaacgtgcaagatgagaggaataaaaataaagaaacgatgcgatcactccaaatgtgtcgttccatagagtgaaacttttcattgttatgttacgacgaatttaatctctattaacaatacgatacaatacaacaagtaacaaccatccaaacgagatgttagtgaaatgactatagaattgtaatgagttgttctaaaataacttttatatatcataatatgggacttttcggctcaaatccagattagtcgggcctcgatgtaagtaccgaataccgagcgagaaatcagagaaaaaaaaagaactcttatagaccacaataatattttaattaaaaataagatatatcagcttaaagggcataactattgaatcagaattcacgccaactgccttgaacaaataggagacgtgggtcacaattaacacgtaaaccgtcgagttgcacgacgaaaaaacacccaacttaaagatatatttatctcttttggaccccttccccttgtgtattttgagttgtaacaacacaggtaagcagggtggattcagaatttgaaggtcgggatatatttttgaattcaattaaaatctgctatgtatataggcaggggtcgatgtatagcctaaattatgaggtacgtgaactcatgatctttccgtcaaattagatatttaatgcacataatttattagaatttgtctaatattatgtgttgacattcatgataaaaagactgaatggtgcactcactacaacatatttatcctaagacctcgttaattttagacaacgcttaaaaagtgttgccaataatatctatgggaatgctttataagtgtattctttattttgagcttttggccacgaaaatttaagctacgtttctaaagtgtactttctaaacgcaaagacaacgcgttttaagtgttggcaaatcataaaatataggtgtaacaagcgttgtctttgttatctaatatgccgtgattttaagtgtggcttgtaaggtaacagttaaaaagcgtgccctaaggttaaagggtatacttgttttggccacccacaatgagcgttgcctaaagtcgaaaagtgtggcctttgatcaaaggtcacacttttcactagtttaggccacacttttccggggtagtcatacgcctaaaagatgtagcaacttagttgaatattgagttattcacctagagaaatatggatcgattcccacctaatatatatttttctatttttttagtggcgtacccatgttcaagaaattctaaatccgcctctgtatatagagtgttaccattaatatataattattttctaaagacgtaattatatatatatatatatatatatatatatatcgaactttacgaatactggtgacccctgtcggtatagcgtaggtccggagggcatttaatttaaggctcatgcactagctagtcttataaagcacacggaggggtcctattgggaacttcagctggatataattttatctttcacgagtcatattcccagggaccatgacattgcagtttaactaatgcattaaaattctataacgtaccacccaaaaacattaaagagctcatgcattaactactactcctatgtgttaatgtcctgtataacaaactgatttgaaaataaccatataagagaataaatcacaacacgtaaacacataaggcccaaaaatattctttatataatataaaattattcgttttgggtcaagtccatacgatttttctcaaaaggtatcatactattaagagatctctatactaggctaggatggttcggacacgtgaggagaagaagccttgatgctccggtgaggaggtttgagtggttggcgttggtgggtacaagaagaggtagagggcggcctaagaagtattggagagaggtgatcaggcaggacatggcacgattgcagatttccgaggacatggcccttgataggaaggttgaggtcgagcattagggttgtatgctaggggtagtcgagcttctccttcttcgtaccggggtgaagcaagtttgataaggttgaacttagttggcttgtggttaatgtagagtccacgctatctgtattgttttcatagctccggaccttatttgttggttattgttaatgcatgtcatctaatttatggtttttatgatgctttactatttctatggtttctgttgacgatactcatgaattgtctcttcttattttatttccatcttcctgagccgagggtctatcggaaacaacctctctgccctatcggggtaggggtaaggtctgcgtacacactaccctccccagaccccactttgtgggattttactggtcattgttgttgtttttgtacactatttatatgtaggctcccaatcttttcagctatcaatgtgagacattgttcgcagtccaataattacccttcgaactaagtttcacgtggcgcacttccatgattcacaggtctcaccctcaaactaaactccatgtggcccattgctacaatccacgggtcaattttcgagatccaccatgtgtcacccacattgttagaatacatactgttaacttcatggttcatcaataacaattggtgttttaatccgagactatgacattcataactgagggcggaccgacaaagacgggtcaaagagaagaactatcagacttctaggcagctggcaagcttatgaagaagggatgtacataacactttaggcaaatctcatatcggaatacgaagaggatacaagttcacatggtactcgtaattttgggctcaataatgacataggtccaaaaacaaatctataaagtttgttgagccgaacggacaatacatatcatgtacttaggctgtgacggaatagtcaattagcttcacttatccacatacacaatatggactgatattttattcacacgtaggcacaaaccactatccttgtgtgcaaaatccaaattccaacatattgcttttacaatctactaaatttgttaataaaaaaaaaggcattgtcaaaaatcagagagctggttgtctcattaaaaacttggccatgctatcatgtttgatgtcattaaccaagaccttccaactgagctaacaagatccgttctgaacttgttttccaactattattgtaccaaatggaccagtactaaataacatttgtataaatccaacaacgtatttccaagaaaatgtcattctgcatcgaaatgctttaaccatcacacctttcgattattgaatggagtacaaaatattacgtggagatgtttcgaaaatgtctaaacgatcacatgaaagttgcattcagtactcttcattgatttgaaaagaaacaaaaggatattgaaggtatggtagatgaattttgggctaatctttcataattaaccgggagaaattcaaaaaaatatactggaggttcatacacaggtgctccgatctccagtatattatgctggaatttttctgttgcagtaaaagagtgactatttttcggtaaccttgcaattggctatttttgaatgaccagtccgaaaactggctagcccgtgctatttttactaattaaccatctaaaatgtgatactaattctaattctaacaacacgaaagatttcattagcttcaattacagaatggaccactttcgcgaacaatacctaaaccacttctttttccgcccaaacggcaaattctggcaacaaaagtccactttggtacaaaaagagagcaaacaggttacagagtagtcggcctacatcagaccctcttggagtgcggcccttcatcggaccctacgtgaacgctggatgttttgtgcaccgggctgccctttgtatagacaaaaatataaaccacttatcctgaaacataaacccgtgtttagtacacggattgtcatggaaactgttgatatagagatacaattgcagttttttgtcattagcatctggtggaaaggttggaaattttgaaactgctgtgcatggaagtggcaataactacaacttcgtccaaatacaactaaataagtatcaaagttaccacggtggaatcaaccaatgtcaccggctgtaggccacctcggtgcagcagtcagcaagcaaaatgctgcacagctgaaattgagagagattttaaatctacattcttagttaacttgtttcctctagactcaattccttcgcttgtaaagaagctaagctagttcttcttactcaaacattatgttcacctgcccttgcttcaggattgaagttttcaccagatataaagaagtgtcgtccagtttgctgctgaaacacaaattaaaaatatatactcagtagactagtttccgcaagactgctccagcccgctgttcaaatttaggaagtgcccactcatgctgaataatatctaagccatccttttctgctcccaaactctgtataacaagaaagatactttagttacgaaaagcaagaaaatataggacaagatgtaatctgtaataaagacgattaatttgttacccaatagaaagcttaaactttgtagaaagtgccgtctgactcacaggcttgtgtatatggaaggatgtaaagataatctactgactttactctgatggtcactcgcagtagaataaggttcaggaatatcaggagcctcgataggtcaatgtatatcgatttcctttaaaatagcaactctagcacaagcagcatgcagttcaatctcttccctccactgagtgaaagcaaatgtctatgcatttcagttttgttcttaccctgtccctctttctaaaggttgctcaagtactgaccactgagtttggaatttaaggatcaagagattaatataacatttttttcttagaaaaaggggggagagagtccaagctaaagaaaaaagagaatggactacatatgcatgtgtattcaatgatagaattccgggtaatttgcattcagaagccgttcatttatctcacttggatccttcactgaaatattctccaccccttcctacagccaaacgactaggctcacctatcagctttacagttattgcagagatatagccatactatggcttctgaaattaaaacaagcgaagagaaaaaacagcattcgatttagacacctgacaacagcacttaaatgaccaatcaaccaaatgaacgcgagtactaatgaccttcttaggaacaaacaggtgtagacttcatgcacgattattcactctggacagcaaaaattcaacactgatacatgttaaaatcgtaggagattcagttgacaatcaagacttagtaatccagattcattcccacttttttttttttgtgtgtgtgtgtagcatctggcccttgaagtagggtgaagcgaaaggcactagctccagctggaaacatgatcagtttatacaatttttcccaagagatataaaaaatgaggagaaaaaagctcctcctttcttcccttttctccacccatctaccctctccttttcctcttcttttcttcttgttccttccaaacagcactcgacctttcctttgatagaaaggaaattttgtttcttggttacataatagaaaaaggtaggggcaggtgggaagcaataagaaggactaatacagaaagaagaaagactgtaacttttgtcttgtttagcacaactaagcaatcataaactgcacctcaacgttggcagaatcaaaataagcaagcagacatcgacaataagcaaggacaaagaattttaccttgctagggtcaaaaccaaatccgctcatttgcatcatacgttgagtgtcatcagttgctgcagcaaataattatattttaatttccaacgacattacaaaaaacccaaaagaaagactagacagtctataaaaccagaagcagtgacatacagctcttatatacatgaataaagcgaccattagacattacataactctcaaaaaaatactgaccattttcttctccaagaatgaggctgaacaaaccccttaatccgaacagattgaggaaatacctgaccaatatgatagcaagtataagataaaaagcagcagagcactacaaaaagtagctttaaagcatagtacttgaacttatggaaacaaagagtgctcatatttaccatgagcgactgctgacgtagctgacatcaacagtgcttaagtcaatgccattttgcaacattgacctgaatctctgagttaatggaaaaggtattttcgctgaaatgataccagacatttatgcaagttaaagaatataaagcttcaaatacttcaaaatgcaaagtgacgaatttggagtgcccagaatctgaattcagaaaaattaaggaatttacctgctacaaatccagagaagaagaagttgacccatgcaaaggtaagagtctgacaagaggaagtacatttaagatgtcaggtcctatattgagcaatatcattaataaacaaatgatcatcgggaagcaagatacctgaggtatgatcattgataaattcttcttcatcatatccatagccatgtttgggtcagaaaacatttgtgcctgtggattctgagcttgtccctttggaacatatagcagtccattttcctgcattttcaagtatatacttgttattttcttgttccaaagcagcataaggcttttcgtgaaaagataatattaaattattaagtttttcagctggtaggctccttagatatcagggagctccaaccgtttcatttgattttttttgtactgtactgcttgcatagtcacatcatgttccacaagatcggattgcactaaaggaaataacctcatttacaaaacatattctttagcaaaaaaaaattaggcacaaaacaaatccccattataatgaccgagcactcaaatcccctttaaagcaatattctcatactcattgctatcgccccttaacccaaactcccaaagagcagtgagttttctctagtaacaaccactgtaccccaactggaccacctttcactggcatcaactcccctccaagcaggtagtcgtgtttctttcactttgattcagctccatcataaaacccacatcccaatctcttcttttcaaatttgtctcgctatctctctttcttttatatatatggtgtctgggccacttgtgctcatctcgactattccacctgtaccaaccacctcccatcagcatagatactagataactctaccatcaacacttaagcagagaagatatcacctagtgtttttttgtttcagttgtgatttgaacccttgaatcctggtctcccatggttttcaccctcttcattaaccactagacactaggctacattcttgggtgtcaaatttctgtttgtcctcccactcctacttcacttagttttcaagctacaatcttcttcttcatgataaacttcaaagaatttcatttttatccagtaacattcagcatacctctctacacttcagtgtacatttttttgaagttctttgtcaatcttgacaagaaaatccaactacccatactataaaccatactccccctacctgaaattaactgtctatgttcactttgaaagccaaaattaaaacacttgacaatcaaattaagcataatatatcagtctttcacaaccaaaactcaactatttgagtagcatttttgtcataggttagtaatcatcaactacattttgtccgataattttgaacaacttgggtgaagcacgcaaaagtggtccctttaacctccaaagttaacttagtaccttaaactggactaaaaatcttaaattcatcgcatatgcttacagcttgtttgaatggttgttacctactgtattgtattgttacgttaaatacgatgtaaatgtgccactttttataacaatcgatttggtgtggtcccgttgttaccttgtctttttatctcaatctcacccttcattattgctaaataattttattttattacttaccctactttttatatagtaattttaccctatatcataattctttttataatattgcaagtttattctacatattgctggtgtgtaacattatgaaatgattggcaaacgacacaatctatccaaacattattttatcaaacgaaacaatacaatacactatgatacgatacattatgaaacgatacgtaacaaccatccaaacaagctgttagtcaacctcagttaataacaataataaacaaaaactaaaactaataagtatcaaacctcgttgctatagtaaaacttccttgcacgaaaagacgtaaccggaataaaatttgctccagctctcaaattccttgccctaattacaacctgcctgataattaaacacaaaacaatcgatcaatcattcaataaactacgcctaagtacaaaattaattaaaaggagatagtaaaatgacccttctttgatgattttaggatctgataattgagaagaagaacgcatgagcttagagacgaagtaacggagaattccaatgagtaccattactaccgataatggtattaatacccagtctcttatcgctgtgtccacactaaatcttctccatttttttcctttcgattttctccgatggatcaattgatctctgttttctcctctttgcttaacaatggcgttttgcgttctggccagtggacggctggttttattatttttaatttttttaatgagaaaaagcacctcgtataaaattaatttacaagaaataattcaaatagtcgtttatcgtaccaattaaattaaaaataatcggcgaatatattatatgtgtataatgatgtataatcaatgtacaatgcgttgtaggctagaaaaagtaaataattaatatgatcggttatttgtgtaaagatgccgaagaattaactcaaatagccgtttacccaaccaattaaactaaaaatagcccgtgaaaaatgtattacgtgtgtataattatgtataatcaatgtatatatatgtatatgactagaaaaagtaaacaattaatatggtcagttatttgcttaaagatccctttagtgttataaaattttagcaaaaagaaaatctatatttatactatattaaaagcacaaaagcccttagcgaaatgtcgttcgtctttttaaaattaaactaactttttaaaaatattaacaaaatatgttaaaacgcttgaatttgttaaagatttcactccaaatttgaagacttgaaaaagtccttcatatataaggaatctcatcaaaatacaaggtccaaatattcctctgcctgtgctacaaaatcggagcttttgcatctatacttgctttttgcgttatattttaatttatatccgctttgcaaaagaaattacaagtgtacccgcttttcgtataaacttcaggcatacgggcctgaaatagcaaatgcaatcatacaaacttcagcattttaggctttttcaaaaacttcagcagaagatgctgaagttatttagctcatttgtaaaaacttcagcagtaaatatgctgaagttttgcactggtatcaggaagggcggcgcctgaagttataaaaattaggatataggttaaataattttaaaaatatgggtataggtaaaatgggggcgaccaaataaggcgccccgcgtaatttttacaataaaaaagcataaaataggcccctttcgtttgggcttggatcaaccctcagccggcccattatcccatttcgaattatttgcactgaatagccttttgtgaggtcactctttaaattttgtcttcgttagttcattgtatcccttgcattatcttatcttgttatggttactgtttgtttcttattatcttgctgttggtattgctgcttttttttacttttcttgagaagagggtctgtcgaaaacagtttttctaccctcaaaggttcctgtgtacatactatcctccccagacctcactctggttttgattatggtttaaaaattttcgggatacgcacaagctgactctgactctaacaaaataagaaaatgtaagtgtttaactttatatatttctcgtatctattccttaggcaagataaactatggtcgatggtaggcttgttcatttggatcgaatattcgaaattcgaaccgattcgctcaatttcggatatttagatcagattctggatcgtgcttattaaaatttcggatattcggatttgtataattgtaatccgatccgatccggaatccgaagttattagggcatttattaatattaaactttaatttcagaaaatcagtacttcctttacatcttcttccaagttattacctttacaattgctggatttggctatattggtaccatagtactctcataatagcagaaacatgaatttttcttactgtattggctcttttacgaagaaaatatacatatgagtttgcaaaactttgaggcataataatccgatccgaaatccgaaaatttgatccgattcgatccaaacactaaaatctcatccaattcgttattaattcaggtcggattcggattgcattttgtagaatccgaaatgccgaatctgaaatatgctaaatccgatccgatccgatccgatccgatccaatccatacacaaccctagtcgatggtctatacgaaacaacttttctacacgtacaaggaagcggtaaggctgcgtactcattaatcattatcctttccagatcctacttatgagattatactcggtatattattatttgtttttttttttgtaaggtaaaccaacatttaaagaaagagttttgcactacgtacgagagattccaatcttgcaatgcatgaattcttcatgaacatgttttgctttattctcgttatatgtgagaaacatgttatgaaaaatgtctatctcattttcttataaatatataaacaatcattatttcccaatttcatgtaattccatgttcttgaaaatggattcaatgactttcccttctaccttctctattaaaaatttccctacaacttttcaagaaataattcccaatattcttccaaccaaaaaataaattttaccctcatacaaacataaaacttcaagaccaaaattatattttctagtttattaatttaaaccaattttatctttgagttatgtctccaaaagtaatggcaaattatgccttgtgaaatgtaatattacagataattcagaaatgccagaagaaggccagaagctatggaaacagtagaaaaactttataatgcacttagaaataaaaatcttaatgaattatctgatataattggagaagaatgtcgatgcattagcaacgttgctcttcttctttagcaaactttctatggcaaggaggtatgcatactttttatttattactttcgttccgtctcaaaatattagtcgtgtttgcaaattaattttgattctaaatatttgacgtttagaaaaataaaaatttattataattaattcttgtcaagagatttacttataattaccttacaggttgttttgatggttgtattgtatcgtattgttgcttagatacaatgttttgattgtttgttaaattttattgtattgtatcgttaaatccgtcgttgcctaatgacgaaaagtgtcactttatggaacgatcgatttggtatggtcgcgtccgtttctttatttttttttctctcatcttgtctttccatattactattaaataatcttatttttatcttttactttacctttttgtgtaataattctacctcgtacctactttttctttataatattgcaagtttaattctctatattgttggtgaatgacatcatgaaacgacagaaaacagtacagtctatccaatcattgtttacagcaaaagatacaatataatactatacgatatacatattaaccatccaaacaagttgttaatgacctgattatataagtattttttatattatcactgcatataatttaaactatatactaataatatataataagtttgatgatctatatttgcagcaagtaatagatttcttcaattcaatcataaagctcctggggaatcactttgagtttgtcattcaacccaccatacataatggaactagtgttggagttgcttgggaactaggttagcccatttttgtatacttttatttttccaattttttttaatcatctgatattcgaaactcgtcaattgtcatatatatatatatatatatatatatatatatttatttatttatttatttatttattggcagcatgcagcgaaactcatgttcccattggaaaaggttttggcttctatttgtgccattattacaaaggcaagatgatgataaggtaaagtaggaactatattgtacagactctctaaaatgttttcgtatttgtgtcagatcctccaaatatatattatttttggacgattcgatacgcacccagagatatttttagagagtcaaaacaatattgattaggaagaaaataatggatcaaatcatcaataaagcatggaaaaatacagttgaagaaaatttgattgaactccttggagctgaaaaatacaatatatgtctatacacctatctaaaagctaaataatgattttcttttataaccaagaaattcttgtgggtcagtgacgtatggttcaaaactcgaaactaagtgaatataaacttgtcaaaaactaaattgcgagtgatgatttaggatttttacataaatagtcggtcaaaattgctgtttacttttttcagccagcatacataaattatacaatgattatacacatattatatatgaatcatacatatattataaatctgccgctaatttaagtttaagcgcttgagcaggcagttatttaagttaattttccttttccctttgaatgtcaggaatgtggagatgttcatggacccaatccttcaaattgagcccgttcgattggtgagtagtaatattttagtagtatgacaacaaaattataaatacatgatctacaattttggctagtactaatatattttccatctattttcttcaattcatcagaaagtatcatccttccttctgagagcaattcaaaagataaatcctccagaccttttcaagggaaagaagaaacaggctatgagcatcttgtttattgttcttctatttgcagctatactgtacttggtcaagaacttacattgaggaatcggcctaattctatgtcttttcgttctgtttgaagaaagaaaggatcccaaaaaggcgatctttcttttcgttgttgaatctctctttgattaatcaatgtttaatattccaaaacctcattactaatgtatgtgttgtccagaaagaggaggactattcgttcgccgaaaccataagttaaaattttggtgatagagatcctgtaaaaactttgtttgaggaataagccagaccgggtcatttctcaagaacaatagctaaaggacagctcgctcgtaactcctctgttggcattggttcatatggctaccgaggatttgattcaatacagcggatgaggaaaatccagcaagcttaaacaagattgaaagtaaggaagacagaaggcgggtagcgaggaagaaaagaaaaggcaaaaagcttttgccaaaacttaatgtaatttaccaacaaaattgtagtaacagaagcagcaaaattttgctgccatctatgaagattaccacaaatgaagcaacgtaaatagacaacaaaatacagatctttgaacggtcatttttttctattcaaattataactggtcataggagatcatttcctcacagcgacgaataaagcaataagtaccagaaattttatatcaaagaagataccccccaatgtagattgtatacctgacatatacatcttagttccaatgtgtttgaacaagctaagaatctattaatgttcctactagccatatattaaggatgccaggattttacaagaacagaggagctactgtacctagaccaaggccatggcataattacaaaaacaaccttctgccataagctcagaagcacatcaatccagaattctaattacataccatgagtctaactatgttaacaaactaaaattacctaagaaccaagatacatcttcggaaacattagcgtattatcaaacgactagacagctatgacctgaaatacctgcaagaaaacacgcgggaggttgtggattaaatcagatggaagtccaatgcaaatgcgtatgggcatcgaaaagcaacaactgggcaaatattcaagtcaaacataatcttgtacacatattaaagaattattagtagaggcgaaatgatgttgtcatccccactaagaacactttatttcctctagaccataaaatttttcatcttacaactaaacagaaagaaagagtaaaaaggggctcatgtatcatcaatcatatatttgaacgagaagcagttgcggggatatccaagagctgaagtaatgtcagcatattctagagaatgttgatgaactgtttatcttaacaatagcaaaccgaaaagagctctcttgcatttgacaaaacagccaaccatttctttcagtttccttcagaaagtatactgtacattttctattaattacccctttaaattattattgttactttttgataggtaaagtcttttattaatatggtacaggaacaagtgcaatgcagaaaaacagaactcccaccatcatactacatgtttccccttaaaaggtacataattaccccttcaaattaaatgaactgctctgtgaaccttctctatcttttaggcttcttgcaaaagaattgtaaattttaactattagtacatagctaattgaaaattgccacaagaaaaatcagtgtaaatatcaaagaatagagttattttataattatttatcgatatgatacaatctccctcgaggacaaaatggtaaactagcctttctgcttatgaagggtcaacgtggcatactttacctaccatagtaatgtagacgtatagtcattgctaaacaaaatgacgacgtgccagcatctgaggtatttccggagcagaaatactttcacattctaggagttcctgaagctttgcatcgcacacaatcaccatagaattcagaggatcctgtgaaattggaaaagcggaaatatgtgacaaagattcagatatatgtgacgatgttgtatagagatattaaacacttgtagtagtgaggaattacagagggaaaggaggtagaaaaccagaaaggaactgagaggagataaccaaaataaaacaggttgattatagagatgcatctacctcaagttggttaagctttatatactcccaaatacgtttcaaggcctctgtttggggtatctccttttcttcacttccaaaaaatttggcgagcgcatcagatatcgtaacagtggaaaaaacaggctgttcaaccttagcagccgtggaatgagtttcaaccttagcagctacagaatgagcttcaactttagcagctatgggctcagcttcaaccttcaatcttttagcttgatcagcttgctcaacttgttctgcaggggttggacaggagaacatcttaagtaaaatagctataaacccttcaaactaaagcaagctatttgtcgatttttccctttttgtcattttcttatacttttgggaagttagaaaataaaagaaagatatgttacaaacagaaatcatttttttatttgacatacttgaaggatctaatgctgtaatatgcttggccagcagcttattcatcttgaacatatcggtacagtctgtttcaaagagcgctcgcagagcatcattgcagataatctttcgtttgttaccaggatcctgtaagttgtgttttctgatgtacacccacagctgtttcacaatctgatcgagcaaagaaagatgcatttatgatctatataacaaccaccaactaaaaatctggagcttctattgatttgaaaatcaaacctctgtccggggcatttccggttgaccaactatgacctgaagttcaggtgaaacaccacagactttgtttaaaccacctggtccacctctccttttcgttccagaagtagcactggacaaaatggaaacaggatcaaatacaggaagttttgatttgaattgttaaccacgtaaacaagtggctaaactcgtacaaatacgggattatgtttactgactgaatcagataccatttattattaagtaccagacattgattaggaaacaaaagtcatctaaaagcacagaacactcaagttcatggcataacatgcaatgtgttcctcgtcaaagttgatgtaagacagtttcaatcaaaatttcccaatatgtaacaacagatggtatataaattgcaaatcccagttagacactagctatatgagctgcattaatctttatacattatagtgaaaaaataattatagtatattttcagatctctgattattatcattgacataggaattactatatgacttactataataccaaaacagtacatctttttaataaataaataaataaaaagcataaccgctttttactcaacctatattcgcccaaccactagcaccaacaccaaatccttcacccccctcccccaaagctcaaagcattagaatatcaaaaataaaaaatacaaaaaatacaggaaaaaaaacctcttatgcatgtctttgtttaatttttcagcaaaaccatttcttccaaccaaattaaattaagaaagaaaaagacaaacttatcctcgtccaaattatatacacatacctttccttgggggcagaagcgacatttgacgccgcatgctgagcagaacccgcagctgctctcgcaaccaccggcgacggagcttgttgctgcacttgcggctgcagaggtggttgccggtgctgctgctgctgaaagtaaaggtattgttgttgctgctgctgctgatgatgttgctgaagggcaaaatgggaataaaattgctgttgcgcagcaaactgtgggtggttcaggagggcaaaatggtctttaatcatcgccggatgttgtaccggctgctgtacctgtgatcggagtagactgatctgatcactgataaactccgccttgtgcgaaaggtcttgtccaagttttgctccgagctgctgtacgacgccgtttaacgacgtaacggcgttaggatctgactgacggagcaaaatctcaacacctctcgctatttcctggtccgacaccatggtttagctttcatatagtaacggcaaaattaacggaaccgtttttttttcttctctctcacactctctctgttactctctgtatctctgttcttcttccccctctctctctcttcaagcttccttttttgcctctctctatctctatctatataagcatttaatgacaaaaatacccttggcttagtttaaaagttatgttcattgcctttttgcattttgtttttttttttaatttggattttccaacaaccgtccgtattataacttttgagcttgattaattttaattgatgcaaaaaagtcttaggataaaatatttctaataatgacaatttcaatcagaaacttaaactcgagatctctatttaacaataaaatagtatttagtactcaaacataatctttaatattccttttatttgcaatttagataatttagcttaatttgacataaaatttaagaaaaaaaagatttttgaaacatgcaattttaaagtttaagggttaaaaaaattgtaaggccataataattgtatgactataaaaacttattattaaggggtcgtttgatatgaggtataagaaggtatagtgctggtataaaaatttgatgatatcttaatattttgtttgattagcaaatctggtataagttattccgggattaaaattagtttagggataacttataccttgtagagggtgtgataattagtgccggtataagttatatctttcttagaaagtgtgcaattattatttttaatacattataccgaacaatgaataaaaaataataccaggataactaatttcaacataattcatcccgacataaattatattcaaagtttcaaatcaaatggcccctaaaagtaaagtgggtaaaataaaaaacttatatttaaattgagtgtgtcttttaaattgagacggaaagaataataaatattattcttttaagataatagcatcgagaagaagcaagggtataaatgcaattatgagaagtggggacccttgatattaaaaaattggaaaaataaggaatttggaaaggataaagataaatgtggggccaaaagaggttgggctgaaattagaactgtcttgtctttcccaacagattttgaaattatcttttattcaatttttgttaatttacttaaataccccacgaaaccacgtgttctaacatggaaaagtgaggttatttaggtaaataaagagtgtttgcgtgtcacagctatatgccgtttgattggattgggtttggtcaacaacttaaaaagctcacgatcttggcaatgtgacaaaagatttccgtataaaatcatatccatttaataccttttttacaatttattctttattctaccaattctttttacgttaactttaaatgattagaatctcgaattcacaagcttgtaattttggttatgcctctacgtatgatgaataccttgtccccgtccccattgagtagaggggttgtttatgatagacccttagcttaagaaaacaaaaaagacgaaacagacaaatacaataccatcaacataaaccatagaaataataaagcattataataaaccaaaaaatagttgaaacacagtacaataaccagtaaggaaaaagggaaaaatcgcgagaacacaacataaaccactagtaatctaagacaaaacctatcagtctatcctcacacccggaacgaaatagaaaaatgctcatctgcctccgaacttacaaccctgatgctcgatctccacactttcctatcaaggggtatatcctcgaaaatctgaagccacgtcatgtcttgcatgatcacctcttcctaatacttcttaggtcgccctctacctcttctcgttcccgccaaagccaaccacttacaccttcttaccggggcatttgggcttttcctccgcacatgcccaaaccatttaagtcttgcttcccccatcttctcatttataggagccacgctcaccttctctcgaatatcttcattcataatcttatccatcctagcgttcacaacacatccacctctaacatcctcatctctgctactttcatcttctgtatatgtgagttcttaaccgtccaacactctaccccatacaacatggacggtctaaccaccactttataaaacttacctttgagtatcaatggcactttcttgtcacacacgactctagatgctaacctctatttcatccaacccacccctatacggagtgtgacgtccttatcgatctctccgtcctcctggataaccgaccccaggtacttgaaactgcctctcttgatgataacctgtgatccaagcccgacgtccatgcatgtttccctcgatctggctttgaacttgcactccaaatactctgtctttatcatgctcaacttaaacttttagacccaaggtttgtctccaaacctccagcctctcgttaacaccgtctcgtgtctcaacaattagaactatgcatcagcgataacacacatcatagaacctcctcttgaatatgtcgtgtcagggcgttcatcactaggcaaataagaacggtattagaatatattaaataagttattactgttgcatttttgactctagtacataagatctgaattagtttgtatatgaaactcgtgacttttttacatgaatttatcgtacggatgaaaaaaatctttcagaaactcatgctaggaaatgctttacagccgtgacctgaattcaaattaatctaagtcaataatatccttaaaccaaaaagacaaaagtagttgaaagggttggaactagaggtgttaatcgggccgggctaatccgttaataatccggttcagcccgacattgtagtaaaaatagcgagctgggacgggttggacggataacgagttttaaacgtacatattttgaaaaacgatataccgaacctgctacaacccgttaagcccttaagggttcttaacaggctgtagctcgtttcagcccgttaacctgttaatttaattaaaaaaactatcaataacattgaaaaagaaaaatataatttaattaaaaaaaataatctgaaccgcccgcccgttaagtctgaacccgtacgggccctataaaacccaaaaattcccaacccattaacattccaatctgttatcaaacgagctgacgatttttatttccagcccgtcccaacctgcccgttaaacacctatacttggaaccaggccggctcgttgggccatttgcccaatttaacaagtattgtggctcgtcactagctaaaacacaaaatccatggcgcaggtgctgagcctacgcgttccaaccccaacgcacacgcagcaccaccgcaccttatcgttgacgcggccgtcactgctaacttttcacactattccctcctccagcgtcgagaatagttttcgctccctacaacacaaactcaattgcaatggcagattttcttgcctcttctccgataaccgcaaacaggtactaacgtttaagctttttgtttcacaatttagctttcattgtaaagaaaataattgggtatatgaacttaatttgattttgcatatgccactgattaaattgaggataagaagaaaaagggtactagaatattaaaggggttttatgtttttgcattaatttttgtttattattgctgctgatttatcatagtgtttgtacttgtgtgcaacaacaacaataaatcccgtataattacacaagtgggatttggggagggtagcacgagtgaatacgcacgccttacctctacaatgaatatagatagactctttccggtacctcgcacaaggaaaaaagaaaatagtgtttgtacttgtgtgcaagggagaaaatatttgaacaattgaacttgcctgagggaacaaattatttacactattagtgttagcttgggctagaaagtgaaattgtttgctgtgtaaacaatctcatcacatgctgctcgagtgcttattgatacctcagtgtcctggagtttatacatgataaatatagcgaataagctactagctcagttgaaactagtatctttggcttagaccctgtaataagtacaaataataggttttaaaccagtaaattagctgcgatgtggtataattcttaatcctaacccataaagttctaatcttagatccacctctaaaccgtaggtagaacatctagcatgtttagatctaagttgtgcgaactcttcgattttggttccgtcccggattcggtcaattgacttcggatactttgaccggagtccatcgacaaatttgggagaaaaattgagattttgatttctcaaaataaaagagatttaggacaatgaaagaataatgtacgtcttggagaatgaaagatggaattgtacaacgttcatgtaagtttttcacaaaatatctctcaaaatttacaatatttttatagctctattttttattagccgaatccccgtatctgtatccagatccgcacccccgaatcttaaaatttagattttgccgaattcgatactcagatccatccccctatcggatacccgcacccgagtccgagcaacttaggtttcgattgcatgaatattgcatccaatttcgcagagtgtctctctcctatcgccgtatcgcatactaatttaattgtgcctattccaaatcctatctgaaactcttacaggatttgattgactgaaaagaggataccacaagtaaatgcagatgaagttctatgttttgggagcaaatttctccacttaatttcataattcatttcttgtatattaaaggaccccgacatctatatttccctctttgtatctcacagtccaagaacaattcccttgtccaggttaaagaaaaagaaaaagaaaaacccaaatgcatctggtctttcccgagctcctacttgactattttagcatagtttttagtattccatcattctcaaaggagagttccaccacattctaggttgttcacgattttgattccattcctttcttatttccaaccttttgggactggagtagcacgatagcaaggcactcaacaaacaaaatgacaaagctcttgaattttgttagtgtagcaattagatgtagtcatgcagcaaatcgaaaagcagaatttgacgttttggtaagatcattagtttcaaatgcttgtgaatcctgacctttaattctttacatccttcattgtgttctctgcaagcctagattgttgacttttcatggagttatggttactggaacagtttcttacttgtcctactagtgaagaggagcttaaaatgctagtaactgatcattttttttgatagtttaggaaacatggaacagtaattataatttgagttgaataaaagacggagcttttttttttgttctacacatttttttgggttaaaaaagctctgtcttttgtaaagacggagcattttaaccccaaaaaaaatgtgtggaagaggtagtgagggcagccattggggctagatccatattcagccatccgcattgtggcagttcaagcttttgcttctatacagggctggcgagttcattatatgataagagcgagatccactagccttaattgccagaggaggtttaaaatcttttggctgatcattatcacactctgatggtgaaaagattcagaaaaggtgtttgctttcattgttgttggatggctagttttatggtgggaggaagataagagacagagttattttcactatctcagcttcttgcgtagttaaccagaagccatcagaccttacagtacctatctcaatttctaggtcatgcgccttcagaccttaggaggcattatctcattggattatgtaccttggtgccaatttttttgacttatgaaaaagaaaaaataatcttggtaattcctatttgtaatatcttggtgaaaacaagagatagagtgaagttttctactaatagacgttggtcgctatcagaggaagtagaagtttagcttagccatgtttgggaacaaagcaagacttctggatgcagctataatttctcgtgtttttataattcaattaaagtgactcaatgtgaaatctataaaaaacaaatgtttcctttttcttttagaagtgccttccaatttctaataggtcattacttatatgctgtgtcttttcatatataaacaggaggaggctagaaaagcgttagaaagtgctctgggaggaaagaaaagtgagtatgagaaatgggataaagaaattaaacggagggaggaagcaggtggaggagacaattcaggtggaggcggttggtggggtagatggtttggtggctctggcgatggccatttctggcaggaagctcaacaagcaagccttgctattttgggtattatcgtcatggtgagcaattgtataagtttctttataacagtctttttcgtagctttaagattgcaactaatatggttattcctcacttccacttgtctcttattcatcagttgcataagcttctgtatactccctttggtcttttttacgtgacattttttcctttttagcctcttcaagaaaagaacgatacctttctatatttggaaacaatgactttaaacctcactttctatccttaatggcattattttctagttacagaaatgtcatggcatatgatcacaaaatttccgaagttcccttctaaaaaataaaaataaaaactccatatgctaactgctaagtcaaacaccttcacatacaacgaaacggaggggaggagtttcttctgtagctataagattcaattaatatggttattctccacttccacttgtcttttattaatcaaaatacttttgtttctaaaactgcagtacttgatagttacaaaaggagatgtaatacttgctgccatattcaaccctctgctgttcacgctgcgaggagcgaggaacgggtttacctttgtaacatcacagattatgagaaaggtatatccagctagccaagacagctttggtactgttcctcaagaggaagtttcttcgcatgtttctgccaaagacagcgtagcgagaaaatggggaagcgattgatcacttgttcaccagcaagtcctgcacttctccttttgtaagattctgatattattacttagttcttccggttagctttttattcggtgtggagagggaggatttgataggcagataatgaaagggggatttggcttcttatatgagagatccatagagagtttttggctaagcattaggtgaaaattgaatcatcagctccaagttattgtgatcttaacatttgaaatggaaatatacacaattttgtaatgttttgatgtgattactatactctcttttgtgttgactgctgaagaaagaaagaaaatgagcttttatgcatttgattttcctattctaaagctattccacacccgggcatggcctcgcggtccatgaagtaggtgaaactcatggaaaattaggttgcaaatttcaatagacacaaaaaactctagttattttcttttcatctactctaattcttggtcggtaggattgctagtgttcgtgttagtgaaaggtaggaggtacttgatggaacactggtggtgcgaacaagcccagtattatctccaccatggggttgggggaggtggtgtgatgcaaacttcatccataccttgggagaatagagaggttgtttccaatagtcccttggctcaggaaagcataagcactacattaatgaaaaggccaaatatatcgccaaccccttaaagttgtcctcccttttcacttaaacatcaatcttaatttgttccatttgaacactttaaccgggcctttactgtgtcattcagacacaaaattcataggcagcaaaatacaaaaggtgctgaacaaaacgaggacgcgtggtttaactttaaaaaaataaaaaaaacaataaatacacaaacctggtctttttcttttttcttcttcttcaatcttcctttccggctaaaactatagagagttttgactgttaatacaagatttcagaaccaaattgacgggagaataattttttggtgacagaaatcatcgattaatgtgtgacattagtcttactatgtcagcattttgtgactaaatgacacgacaaaggcctagttaaagtgctcaaatggaagagacttaagattgagtgtttaagtgaaaagggaggacagctttaaggggctgacgatgtatttggcctagtgaaaatttcgacaagaagagacattaccaaaaagccatataagagattaccaaaaaattatataagagcagaataaaaacaacaagatagtgaggagatcaacaatgaaagaaaacaacgattagtcataaacgcttactaccaactgaaagcagactgcgtggaaatactactattatgaacactctggactaccctaatcctccaactctatacattcctatcaaggatcatgtcctcggtcaactaaagctgcgccttctcttgccaaatcacctctccccacctcttctttggcctgcctctacctctccgtaggcctccaatgtctacctctcacacctcctcatccgggcgtctgtgctcctcctcctcacgtggctaaaccacctaaggcgtgcttcccgcatcttgtcctcaatatgggccacaaccaccttatcgcgaataacctcatttctgatcctttctaacctggtgtgcccggacatccatctctaataccttcatctttatcttgactgaccaacactcagccccaactctaaccaccactatgttgaacttacccttaagtttcgatggcatcttcttgtcacacaaaacaccgaaagcgagtctccatttcatccatcccacccaatacgatatgtgacatctttgtcaatctcctcgtcccctaaataatggacatacaaccaaccttactaatttaatgaaaaaagtaattaatttaatggacatacaaccaaccttattaatttacttgtgcatttccatgatgaagaagccatgattttggatgtgttcatggtaataatagtgtccctttaacaacaacattataattttaacaacaaagaggaaaaaaagtttttaaacttttctctctaataaaggaaaggagaaaaagattaaataagaaaaattatttccacaatattccttaattatgtcagcgtgattcattccaaaaagattcaccaatcatcactcatagttaatactaataatcatgctaattataattaaatcgttgggaatataccaagaagttcttaacacttatcaaaataaattcaaaggccccattaataatttcaatctggttaaaactcccatccctatcttcttctcattattattattattatatattattattattattattattattattattgatgtaattaagttgaaaaaatcaattttttaccctactaattatttcacatacctctctccaaaatttatccaataccaagctcatgattactttttttttttttttggaaaattaaattaacaaagatattttttcaattaaataaacattcgaaaaattcattttccattctttcaggaaatttatcattgaaaaaatataataataataatcatttttaatgtaggttttagataaaattcttaataccgttttatagatgcatacgtcaatatcaataataaattctctgaagccatttatgttgagtcacgtgaaaataaatagctatagttataaaaaaatgttcaatctactgaaaataatatctcagtcatgagacatgacattgcctattaatttacctttttatttgttggaaagaaatgtatgtatggttgaaaatgaaaccccttttccagatatgttattaaaaaaaaaaaatctactttttggaaaagttatttctccttcgatatatttatatttattaaaatgtttactaaataagcacgaaatcaatcttcaacgcaataaatcaaattgattgtggtagaaacaccaaatcgaactcatagagtttaaattctcgatcctatctctcgaggagttggtcgaataagaataaaaagtaatatataaaatttgtgaagagcatagaatgtcttcgaaacttttattattagtaaaaagggcagtccgatgcataatatacgtattctctattcatacaggatcagaaaaataatagcatattaaaaggtatagtatggacagtctaatctaataatatacaattatgtatattgaattttccccttttgtagaacgtatgaggaaatagaaagaattctccttccatgacatgatgttgccactgtcatccttccatgtttggccagtcctttttctcttgtaggaaaaggtttggatttttacaaattgaggatcgttcctttcattcagtagcatccacaatgtagccatatgggtttgagaatagtgcttagggggagaactttacgggacaagtgtagtgtgtcacttgtgtttgcctcttcgcgaggttgttctctcaatattttttgtattctcttgtatatagtggattgctcatctccgccgtagacgtaggtcgattgaccgaaccacattaaatgtttgtatctctttttggtatatttctcttttgttgtctgatttatcgccattcaaggtttgctttactagcttccgtatgacagctgacttttttcggtcgtaaacaacctccaacataatcagtggcggagggagagtagaacgtgtgggttgggccgaacccagtagctttggttcgaattatgtatttatcttaaaaaaattattgaatatgtgaaaattattaaattaaaacctcagtaacttaaaagaattagaattagaattccaaatccataaatttcaaatcctcgctctgcctctaacatagtcagtatactatagctaaccgatcaaacgagttaaatgggcttttatttgttatagaaaaaactcgttaacaaattttacacggctcgaatctaaattagtcggcatacatgtaattgtaccaaaagaaaaggaaaaaagaaaacaaaggtgaagaaaatattaataacggtttgaggtaaaggatattatagagtggaagagatgcacctagtagcattgggtcgaattatgtatttgtcttaaaaatttattgaatatatgaaaaatattaaattagaaccccagtaacttaaaagaattaacccataagtttcaaattctagctccgcctctgaacataatgattataatatagccagcccttttaagtacttgaatattgcctaattgttcgggttcttttatggttattgcttctgcgaacacagtagctaaatattcccaatgcgttacgaagatgacattatgtattgctgcccactaacaagttatcttaacagtatctatgaagtggcggacgcacgtgatggcaaaacccgcttcaacaaaaaataatactgtatatgtataaattacaattaaagctgtgtaaattttgtataaatattttagtagaacccactagacaactataattttacgactaaagttgtatacttttaagattgaattcgtttgcagaaaatcttagatccgccactgtatctatgaacatagaaagacctaaccgatcaaagaggtgtagtatagactgataaatgggcttttatttgttataggaaaaaactcgttaacaaactttatatggcgtgaatctaaattagtcggcatatatgtatttgtgccaaaagaaaaggaaaaaagaaaatgaaaaaaattataataacggtttggaaaagatgcacgtagtcctcaaatgaataattgtccatgagaagatgtcaaaatatagttgaattgaatatatatatatatatatctcttccacccaatcctaagctgtctcctaagtgaccttcacgatctctcaccatttttctctcttattattattgttattaaaaattattaattttaattatttctattattattcatattttgcaataattaattctcacaatatttggatcaccacataaccatttcattttgcacctcaaaaccaacccaacccctccaaatctttctcctttttctctctcttttttcttggtgtctttttcttcttaccattgtagtaatactttcagggtatttcttttcattggattcttttttgactatttttcaaaaatgaccaaaaaaatttcttttttttttataaagggagattctttgtagactctcttcaacatgttgttttttctttttgggcttttctagttctgttttttcttatcataatatcaaaatctatttagaacaaaactagaaaaagctcttttctttctttttcaagaacactgtttttttttttaaaaaaaatttccttggctgttggagttgctgaaagcagcagcagcaaaagaatgggttttgatgataaaaatgtagaaagcaaagatggggcaggagcaaattctgagggtaataaaggaattattgttggtgattctgaccctgagattgagaatgaaagtgttgggaataataatgataatagagttagtaggcaaatgagtgaaagttcaatttatacaactgatcaagaagaggatgatgatgaaactaataacaagattgagttgggtcctcaatgtatctcaaagaacaatttgaaaaaggataaggtgtgtttgtttcttcccttttatattttcttgaaatgaaaatcttttctttttataaccattgtgtcggggccagctttcgcgcttcaactagcaaaagtaccggataactctgtctagcttagacaatttgaaagaaattacatagtgtttttgcctctgctggaattcgaacggggcggacgctgaaaaattacactgtataagtaaggcaaatcattttttatctctatatattatgttttgaatccccttaacacaacccaaaacataactcagtggtaaaggggatcaaaactgttataaggtcattggttctctattcccactagctacaactattttaacattttcttttttttgtaccccttggctgtaatcctgcctccgccactgattcgaacctgaaaaaaatgctatctttgttcctttttaatgtttattttgtgatatttgttttgatttgatgcaatgttggtttataggatgatgagagtttgagaaggtggaaggagcagctccttggtagtgtggatattaatgctgttggaggtaaatatgtttttgtttcaagatttgctctgtcaactttgttattagatttctggttttgtttttcctgaggaaagagcaatgtgcatatgttatttttaggctttgtttccctcctattgggagttttcatcatgttctttcaataagctcatgaaatttgaaatctttttgcttttcttgcatctgttactgcttttagtttgcataatacatggtaaaaatattactccatttgtcaaattctatggattagttcaaactgcatattgaaattttgtaggatatctctcactttgtggaggtcgagcattagggtagtagattagggggtagtcgagagttcttccctctttttgtaccggtgtagtctaatagagttttgtttaggtttgttagtggtctatgttgtgttcatattttttttgcatagttttgtgttattgtcctttcacttattcgttgttgctattttctttctgacatcttttgttgttacatcccctttcttttgtttctttgtctctcctgttgagctgagagtctcccagaaacagtctctaagatctgcgtatactctaatctccccggaccccactagtaggattttactgggtatgttgttgtaggatatctttcactttactcttctttcccgaaggaaacgcgcacaaatttttgtttcatcctcacgaaatgtctggtagttaatcagcgtttaaattgaaatagaatgcaaaggagatagtcacaaattggacctattcctatatgaaatttccaaacgcatctaaaaaaggaaaacacagaaaattgtgttggatcagttgctctatgcttatggtggatgctaaatagaaatttgcttcggattgaaggatttccatgctaatgagatgagaatcaaagaatcaaatagatcacccgataggttctttattgtaaacaacttggtgggatcttccagcacaacatcgtttttccttttaattcgaggattttcgtcttgactaacttcattggtaaagaatagaaaacggctaatagaccgcctggcgtggagcatgtatcaattcatgtctagtgtcaatactattctcaaggtcattgaaccactcctacgctgctttcgttttcaagatatgataaggtcaggaattccatagatttctttactcgaatttcctctattcgtatattcatttttctgtgacgcgatatgtaatgtctcagcaggattctgtgattggtaaaatcttgatgaccctttaaatacatttgagaataatttatgtttctgcgccaaaaaccaagggtttgatataaatcttgatagttttcatgactgttgtacaatgtagaatccctggatccagaagtgaagatcttgagccttgaaattaagtcccctggtagatctgatattgttctccctatccctgcggacggaaatcccaagagcccatggttcgtcctgaaagaagggagcaaatacagcctaaagtttacattccaggtcaacaataacatagtgacaggtcttaaatacacgaacacagtttggaaaaccggtatcaaaggtactattccgtcccttcacgtttccacctctacgtcaatgtcaattcttaggcctaactagtttgttcttgatgttttgactaatgtatttccttttttcacaaatgttattaagtggacagcacgaaacaaatgatcggggcgttcagtcctcaattggagcttatacacatgaaatgccagaagacaccaccccttctggtatttttgcaagaggatcttacactgctaggtcaaaggtaatttttctttttctcattaatgctcttaacatatctttatctaaccattcaataaacgtagtaatcctataaacaccagaaactgaattatgaagcttctagtcttgtgcacggcttagttatgagcaaatccgcaagcttatcatgcagtgaatttggcgaatctcatacaagggggtacattaaaagactaaatgaagcaaggttaataggtttactagagtttgtacacaacatctgcattgtagtagcaatcaccctaactgaaatttgctggttgtcgacgcttcacatttatatctttttggcccttaaagataaggcatcaccaaaaagtgcttctaagcaataccaaaataagtccttctttcttgttattgctttgtacgcagttccttgatgacgataataagtgctatttggagatcaactatacatttgaaatcaagaaagattggcaggaaaaatgaacgacgtcatgacttgaattgttgccctccatacttaatcttgttttcgttcgtcacaattatctcagttttattctgctagttttacagaagagaaaaaggaggggaaaagagaggcagaactacctactacaattgattacatcaaatgatgaaagaggggtgaacttgagttggggttcttgttttgttgagttatcaattcagtttattgagcttttacatgtgacagattaacaaaaagctctcttttcttcctttcatgtgcataggtgtgattgtatttctttttgaatgttctaaaactgtgaagatatctttttcaagaatctagagattttgttcgtctacattcttttccttccattttctccttatgatttccattgtcgtgagccgagggtctatcggaaaccgcctctctgctcgtccgaagtagggttaaggtctgcatacacactaccctccccagacctcactttgtaggatttcactgggttgttgttgttgtcgtcgtcgtcgttgtatgttctcattatgatattgcatccttttacttaccttccaaccaaagtttgtcaaagttatgttctttggctacttttctcttttgactttagtcacttgttattttcttttggttgcctcaaccacttcccccaccttttccttgcccataattgaacttgacatttatgcactggcatgattgttcataatttttctgggtaaaaacctataaaagattgaaacatgtatggtaaaaccagacccttttggttcttgaggatatattacttttattgagatcagactcatgtaaaaaccgggtaaggagagtagaagtgtaagcccatacatgcctagtttcccctccaagatcgggtccgaaccatgtcgcagacaaaaaccgggtaaggagggtagaagggtaagcccatttttgtcgagcttcgaaccgtgggccactagtcctcaggatttctcggttatgatttttttttttcgttttcaggattttggtctaatagtaatagtgcaatacatgatgtgtaggtgaggctcaaagctcgtgtagagggatggactaatatctatcgagttttgtatcgtacgctactgaccctccaagttttttggattatctgaaaaaagttctaaatttttaaaggttgaatacctatattttttttttttgagaatggtaacataaaatttgaaacactatgttttggcaaatacttttgaggcaaccaaaagataagagtttgagggtgtgtttggtataacggaaaatgctttccgtggaaaatgtttttcaagaaaatgctttcttggaaaacaagtagtaatcttattcatttttcggtatttgatacgcaaattaaggaaaataacttctcaagagtatttataaataatttaggccaaatacctgtgcggccccttaaacttggctccaatttcaattttgacacttcaactaaggccagtacctattgaacgctccaactaatttgtaagtgtacctattaaacacatcacttactaccggtcaaaaaaataaagtgcgtgttacttacgcggatgaggtggcaaagtgacgaatgatacaaaaacacgtcgcatttgggtcagcataatcttaagaaaaaaagaaattttatttccacataaaatcccctccccaacctaagtagttccatcgtctctcacctctcttccccgttcctcctccttcaccattcattgccaggcaatcctcacccatttacaaataaaaactactcaatcactttcgaccgtagctaccatcaacaccgtcttcaccaaacatgatgccgatttaatacttggacgaggcagaatagaaagataagaggactcactcaaatatactgatttttcctccaaatctatggttatctttccctttgagaacgaatttcttggggtttcctcttcttcttttttttttttcctttatgggttttaattattttacgatttaagtttttttgttaacaaaaatttaaaatcttaattttttgattgaaatttaagaaaaatttaagttccaattatttttattgagaggaagaatgtcaattgtttaaaatcgttgtgtgtacctttgattcctctgtttatgtttaatgaaattgaagaatctgaaagggaagtttttgttctgtgttaatggtgattttctctgtgtatgagattttttggtgaaggtgaggtgagacgatttagttttggtgaagctggtggtgcaactgtatgtgttttgtattgttgaagatcattgtaatatttttttaaagaaagacagagatattgaagctggtgattatggcgttttgggttcactccaccgtggttcacggtagtatgtcctggagttggtgaggccattttgggttaaaaatgtgttttaataattaaaaaagaaaacaatatggttttggtatgagtttcactcgctttgggaaagtgagaaacacttgtttttgccatgtcggactttgtgtttaataggtacacttacaaattaattggagtgttcaataggaaatgactttagttgaagtgtcaaaatggaaattggagccaagtttaaggggccacataggtatttggccaataatttagatacaataaacatgaagtcataaacttttgaaccaacaacctcccaacccatatatttcataaacttccgaactgctaaactttcaaaaccacgaaatttggaacccgtaaacttccaaacacataaacctctgaactcataactttggaacttgtaaaatttcgaactagtaaatcgaaagatgaaaaaattaaaactaaaaatatattaaaaaaatctttttttcttcgggaagaggggtggggtgggatatagtcgaattccaatacagataccagataccaggtggaaaaccaaaaaaaaaataatagagagatgtttcttctttcagacattttctgtgtttaagcagatcatgtacaagtgtgagatatagtgaccagaagataaataactagtcacaaattaattacaattaaaataatcttgtagttactaagggaaatttttaagtaatgaactaagatgtctcctgtgaagttctcaaccaatatacaatctttatgtctcgagtttgcgctttgagaatcgaatccttttcgtaaggagccctaactactctgtagtaaattttttataatgtgaatccagattaatcgggtcaaacgttttcggacacgaaatacttagtgttcctatcttctgcacccttttctgcaattaacagcagagtcagattgacatttctatcgtgatttaatgactattatttattgggttgtaatcgttatgtatgagtatgttaggtacctgtgactcgattggtgaaataatatttctcccccaaaaagcatatttttttttaccgacgcaattattgggttatttttacatgtcttcctttgaaaaagaacaaggtcaaaatgatgttaaggagtataattaggttggatttaaatacagtcaaacctctcataacaacatcgtttgttctgaatatttttgaatgttatagcgaaatgatgttatagagaacatatattataacataacatgaaaattggttccggaaaagcttgacttttatagtgaactgttgttatacagggatgctgttatatagagatgtgactgtaataaactcttatagagttaagtaggtgggttacaatttaaaaattgcaagtaagtcaaacctctctatagcaacctcgtttgttctagatatttttggttgttatagcaaagtgctgttatagagaacatacattacagtcgaaactctctataacaacatccctataaacaaaccattcactataaaagccaagttttttccgagccgattttaatattacgttataatatatgttctctataataacacttcactataacaacccaaaaaatatcggaacaaacaaagctgttatagagagatttgactgtataacataacatgaaattttggttccgaaaaatcttgacttttataatgaagtgttattacataaaaatactattatatataggtctaactgtacatgctatcattaattattcttttatccatcgtctttctctaaggtatccctttcattaggtaaaataaacgtttaaaacaagtatataatatatggttttattttattttaaacatactacaaaaaagtgtgaagtaaaatggaattattaaagaagaaaactcgagtgaaatatcgaggaaattattacaaaatgcgtcagacaacaccttattttaaacatgaaagtgattagggcaggtaagtgcagatgataaatatttctctatctttattcataagtctcgagttcgggttttaagaattgagtcttttacgataaggagcctaacaaccctaaagtggattttctactgcgtgaatccagattaatccggtcaaacgtttcccgacgtcggatacttagcattcctatcttgtgcacctttttctgcaattaacggcagatgcagattaaggagaataattaggttggatttaaatattaaattaactcatgagagttaggtaggagggttgataatttacaaattgcaagtcaacattcaaaattggaatgcttgtttgaaaagaattgtaagttctcatggggtttcctgctaccaattttgacaatcattttaataaaactaatgaaagtaatgattagcaccaaagaatagttgttaattacatggaaataggttgagtgatcttttggagtctatcaaattacattgaattgagattttttttattagtgcaattttaaatcaataaaggaaaagagaaatatgtgtttatgttataaataaaattctatttaaggtgaattttatatttttaaagagatcttagggattttatttgtggctaagtcactctttccctataaatagaggggtactattctattgtaattcatcccaaatcaataagaattctctttcccttcttttctatgcaatacttttcttcttcttttttattgttttataacatgttataagcacgagactctaaccaattgagtagaagctttgggattgtgcataatgattgacaattgttccatgaatttccttcgtgatcaaattctggatttaaggtaagtattttactatattttttcttttaaattcttgaaattctataatatgattttaaatacaagcaaagacaatatactttgattataactctaatagagtttgcaaaaaattataaccacatgaagtggtaaaattgctatgtcttgtcatgatcaaattcatgtatgattatgggcacaagaagtgaaaacccatcttattgaagttgcttcattctcatccccttaagagaatttgatagtaatatatgataagtctggaagaagacaaaattattaccgtgaagtatcaatggatgtggacgtgaaatagacgaaattataatcgtcatcatcatgtgataatgagaataataagaattctcaaaataatctttcactctgtgaaagtaatgttgtcatgatttgacatgagattttgtaaagcacatatagatgattatgtccattcatgatgtgaattgataatactgatttatgaatacatattcattctttgaagaatatgaatgtactagtatataccacgctcacctctaaaaggagtttgagatgaaataagaaataatattcattattatggcatgaatgatcattggatcacgtacctattatgatatgccaaaatattatggtaatgtgattattaaggcaaagtaatataagaacatatcttgctatatgatataccatgaccataatgtatactttctctttaaaagagatattaccatatggatgttgatgaatatgtggtagtaccaaaattaattgagagctcggaagagccaattattactattttggaggaatacaattgattatcatgtcaatattgtgttgtataagtctcaaagaaacttattagtttctaaagtattcgcgaaagcggttgattatattgagactataaataaaggaaagatttaatatcttctattactacaactttagcggggtaatatgtatgtgaaaagttaccgctttattctccagtttgtactatacaaataaaagaataccacaataaagtgatgtttattgatataaaaacccatatcataataaacttgagtttattgataattagcatgtcatggtgtaaactgaatttatcaatattgataatttattcagttgcataattgtttagccatacaatttaagtatgatgtgaaaaataaagaaattcacatggtaaatattaaaaactagaaattctttacgaattctcttatgttgcttgttctcattaattaatagacaactaaaattgggattgaatcccatgaatgctggaaatatcaaaggtgaattgagctcattacctgccatgtatccacataagatgcatctatgagatggttacattgcgattattattaacccgcaacttggtgtttgcgaggtaacttgctcaataatttaatttagagcataattttcagattttctattcaagaagttcatcttgataagttggtttacatcacagttggtttagcaaaataatttattgagtgcctccacttaatagctaaactattgcttatgagaacaagttatctatatcatttgatatacagttatatacgaaagtatattacattctccctcacaagtggttcaggtcaggaaccaaataatttcatatgtattattgatgtgcggtgtatattttattaacaccataatgcacaaagatggttccaaattgaggaagaaagttgtttttctaacatgagggggagacaagaataaacagttgagaaaaagttactggaatgaattatcatttgtacatctagatcctcgaataagataatatgaacttgaagttcataaaaaggataattcatttgctatatgcaaagcatgcaacgcatttgctgacccaaagaaagtaactatattttcattgaaatgctcctattaagtcctagaaggacaaagtctatggtacacttaaagtgtatagacaaatcggttcaaataaacttcttgataaagaagatgagtaaattatcataataaaataggaaagtgatcttgaaaatcacatgacataatatttcataaaatctcaggagagatttagatacctgaatatagtaatgaaaagatctctatgtgtaacgacccgatcggtcgttccgagagttagcaccgtttttcctatttctgctttattatgtgttgttcacctcttttatgttgtgtcaggttaattatttcgggtccggagtagttgtggagagaaatgagtacttagtctcttgagttggttaaatagttggaaaagtcaaccggaagttgacttagaggtatatggcctcgaaatgtgttttttatgatttggatagcttcgttagtgatttgggacttagaagtgtgttcggaatgttaatcggagatccggagcagaattaggcttgaattggcgaaattgagtttttggcaatttctgctcggcagtgaaaaattagctatcggattcggaatggaattccagaagttggaacaggtccatagcgtcatttgtgaggtgtgtgcaaaatttcaggtcaaccggaagtgttatggttggtttcgcattgttggcggaatttagaaatttctaagttcttaggcttgaatctgaggttgattggtattttggcattgtttttgagtggttcgaaggctcgattaagtttgaataaggttatgggatgtattggcatgtttgttgaggtcccgagggcctcgggtgagtttcggatggttaacgaaccaattccaggattttgaacttggcagatttttggtgttgttgcagagaaattttgttcttcgcgtttgcagtggaaggccgcgttcgcgaagagtaaattggggagctgaggattttgttctatgcgttcgcgtagtagtggacacgaacgcgagagtctgagtggaggaagcaccacattcgcgctcagagggtcgtgttcgcgaagaggagttggcagttggagaccccaggtcattggtctatgctttcgcgaggtaaggatcgcgttcgcgaaggcttgagattgtaaagcttcgcgttcatgaagagttgattgggaggcagtcgaggttggcctagcgaacgcgggaggaccgtcgcgttcgcaaagaaggaaaactgggcagacagtgttaaattctaaaattgagggtttaagtccaaaacctcaaaaacattggagagctcgggagaaggcgaattttgaagagattttcagtacagtaattggggtaagtatttctcacttgattttggttcaattccataatttagtcttgaatttatcatttaatttagggaattggagtgaaaattgggagaaatgaaagaaaatttgggaaattcttttggggatttgaataggcatttgaggtcggatttcgatgaatttgatgtgggttgactcgtgagtgaataaggattctagttttgtgacttttatcggatttcgagacatggactcaggggtcggtttggccaattttggaattttttatgtaaattggttattttcgagtgggctttgttccttagcatattttgatcatatgaatctgtttttgaatagattcgaggcgatttgaggctaagtcgagcgacaagggcattgctgagtagattttcatccgtttgaggtaagtaaattgtaaatctagacctgagggtataaaactccggtatttctattatttgataaatggggtgacgcacatgctaggggacgagcgtgtgggcatgcatcggtcgggattgtgacttggtccgtcccgtagtgactattaagtcgcgtatttgatttgaaatcatatggtatcccatattttagagattgatactatattttgggctgtacgctatgtttggggccttgtgtcgacctgttttggccctcaggggtattttactactattctcaactgttttgatagaaaatataatctcaatcatgattatacctgttcactgtttatcactctattttaattaatgaaagatattttgggctgagtccctgtgattgtgatgagttgggctgagtccctgttatttgtgatgagttgcccgagtggcttgtgaggatgactgagtgaggccgagagccgaatttgtgaggatagttagggatcgggctgcgcactgcagcattatatacatatatatatggatcaggctgctcgccgcaatgaggtatatgtggatcgggctgcacgccgtaacaagatattggatcgggctgcacgccgcagcgatatagcgcttgggctgtaggagcctcctcggagtctgtacacccccagtgagcaaaatcgtctattatggatcgggatgcacgctgcaacggttactattatggatcgggatgcacgccgtaacagttactattatggattgggatgcacgccgaaacgttattatatggatcgggctgcacgccgcacgattgatatatggtacctgttgagtgagagtgctaagtgtgagcattaacttatgagagtagagtcacgagtgactgagcggttttctcgagaggctatatttgtgagtgataccttgcctgagaggctacatttgtgagtgatactttgtctgagaggctatatttgtgagtgatactttgcccgagaggctatacttgtgagtgatacttttcccaaggggctcatgtttctgaaactactgttttcactcttcttttacacggagcctttattgaaaaatgttgaacaaatgttttaagcaagtttcattgaaaactgtgtttttacgaaatgttcagaatttaaattcctgatttgattaatttatttccactgttgtttatattatgaaattaaataattttatatgctcgtcattgcactcagtctttagttataattattactgagttggtgtctcacgttactccctgaaccttgtgtgcagattcaggtgccagggctgagtaagaaccgatttattcatttggagcttattaagagatttatgaggtagctgcacggcgtcgcaatcctgccttctccttcttaccatttagagtttattttccagacctatatattttctttagatacttacgaccagtgactccgggattttggtattgtatctattattcggcatatcttagtctgtttaaaaatgcttaaataatttttttatgaattatcgatttagaaatgatataaatgaaaggttctttatgtttagaatattgatttggctggcctagtatcgcgatagacgccatcacagccggcgtagttttggggtcgtgacactatattatgtctttgtgaaaaaaatattaaaaccgattaaaatgttcgttgactacatctattatagcgctaaatatagatgaggatcttaagtctatcgaatacagatacaaaaatattggccaaatggaagagacacaattcgaatagaattggtttcatatgaaatacatgtaattttggacattagttcaaacactcgaaagtataaagtcaatggtgtgtgcaatcactttaatgtacttatatgtctggcatgacatgaaaattaatgcaaatctaaagtctattacatggcttatatgacataacttatatgacaatccatgaatgatattgcttagcatatagaattcttggtcatgaagtactacatcctaagtacaatttgtgcacacttctatcttgctataattataagcatgataatgtaatagcgaggtttttcaaggtgcaacatattcattaaagttaataaggatgatttattcatcaaatctctgttgacgttaacctccaagaagctagtgcacaagattgagatgtgaaggctcgaggatatgaattgatgctctaatcaggggagttaatacgcgttgtactctgtttcctttacaaggttttgtcccacttctagcaaggattttaacgaggcaaccaaaaggtgtattaataaacatttgttctctttttcttttctagaattttttttcccattgagttttattttagttaaggttttaacgaggaacattatctgttgaatagacattcaagggggagtgttacaaatagaattctatttaaggtgaatgtctatatttagagagatcttagggattttacttggtggctaagtcactctttccctataaatagaggggtcatattccattgcaattcatcccaaatcaataagaattctctttccctacttttctctgcattacttttcttcttctttttgttttataacagtttagttattaatggtcgctacatgttttaaaacccaatcacgagaatagatttatttattcaaaacctactacaaaaatagtgtgacgtaaaatgaaattgttaaacagaaaaggtttaaatatgcccttgtactatacgaaattgagcacatttgccctttgttaatactttagcatatatgtgcccttacgtcacatagttttccatatgcccttgtactatacgaaattgaccacatttgtccttcgttagtattgtagcccatatatgtccttgatgtcatgtagttggtccatatataccctttttcgaaacggaatccacccaaattaattagtttttcgttaattgtactaaagtgcagtacaaacaatatttcctttttattttactagtactttcttttacctttctatttttttcttcttttttatttttattttttacttttctttctcccatatctagtttcctccattgctgatgccttctccattttcttcaccaatttcacttgacaaaattcataaatttatgctaattttactactaaaacccccacacgttcttctgacctgaatgagataaaaatcgccggagaaaatttttcggcggtgttacttgggtgaagggagtttatagttatttaacttttgaaggtgttgttcactgtggagcttccagatcttaaggaaacaagaccttcaaaatctgaacaactacatactccttcacccaatgaataatatcgaaaaaatttctccggcaatttttatctcattcaggttagaagaaggtgtgggggttttggtagtaaaattagcaaaaatttatgaattttatcaagtgtaattggtgacgaaaatggagaaggcatcagcaattgatgaaatcggatatgagagaaagaaaaggtaaaaaaataaaaataaaaaagaagaaagaaaagagaaaggtaaagaaaaaaagtactaatgaaataatgtttgtaatgcaatttagtacaattaacgaaagagctaattagtttgggtggattccgtttcgaaaaagggcatatatggaccaataatctgacatcaagggcatatatgggataaagtattaacgaagggcaaagtactcaatttcgtataatataaggacatatatggaccaacgatatcacgataaggacatatatatgctaaagtattaacgaaggacaaatatgctcgatttcatatagtataatgacatatttgaactatttccgattattaaaagaaaaactcggctgaaatatcgaggaaattattacaaagtgggtgtcttctcatctcgttaatggaatttagcagccttcctctatttgtccattaccacgtgatcattttatcttgttgactgattatttaattatgaaaattttaaatattgatattcaactttctttaataatgatattccaatgtaaacaatgaagaaaataatgaaatataaaaaagcttaaagaattaagagtacaattctcttcaagtttgttatcctttttattttagtattacatttttatttccttttattttacttttaccttttagttttctatatctctgtaaatatggagacattatttgaaatttctgaatatagaatagtaacaattagctttctgattcaataaatacacagccacaaaatttgtctagttaaatttaatgttgtatataggttggttggataaaaattccaaagaagtctgccctacgttgaaaactattattccaaaaaattatgaccatattaagagcctgtttgggcacaaatcttttttccttttttccaaaaaaaaaaagctattttttccgaaatcagaatttcttcgtaaaattttcaattttcaattgaaaatgcattttagaaattttcgaaaatataaaaaactccaaaaaactgttttttaaaattttcactcaaatcactcgcaaaacttcaaaaataaatcaaactaaattttaaatccaaacaacaactctaaatttcaaataccattttcatttgaaattttttttcgtcattttatggaatttttcacttcttatgtccaaacgcctactaaggaatacaaatttggacataatatctccaattacacgtgtcaaaaattcattggtttatttaaatatgttttattaatcatgtctccttctgcttttgttctcttcctttattgttcttcttttcttgaagaataaaaggagggaaaaagtaaataaataaaagaacagagttgtaatatggagggaaatataattagtgtgatcaaatattggattgaaggagaaattgaaatttttattaaggtatggttattaatttatgcatcactatgttactgttatttagttattaaaattattccaaaaggtttatttaggctcttatcttttctccctatgatttgttttttcctttatctccctctgaaaattaactctgttcatctttgtggtaatactgcttttttcatttcttggctttgcaattttaagcttcttctccttgcttttgaccaaggttcactttctgattcttcactttctatcactaaatttctaatccttgcttgtctccccatcaagattcagcaaaaatcccaagaaaaatctgaactttatgtgcaagatgaggttaatagaggtagacttcatcaaaatggccattttcgtaaaaccccattaacaaagtcagctgaaaaagtttctggtgtgcaaataagaaaggattttgacaaaaatggccattttcaagaaaccccatcaataaagtcagctggaaaaatttctagtgtacaaacaagaaaggattttgacaaaaatggctattttcaagaaaccccatcaactacatcagctgaaaaaaatttcgtgtacaaacaagaaaggattttgacaaaaatggccattttcaagaaaccccatcaataaagtcagctggaaaaatttctagtttacaaacaagaaagaatttgacaaaaatggctattttcaagaaacccatcaacaaaatcagctgaaaaaatttctagtgtacaaataagaaaggattttgacaaaaatggccattttcaagaaaccccatcaacaaagtcagctgaaaagatttctatgtacaaacaagaaaggattttgacaaaaatggccattttcaagaaacaccagctcccctctcagctgctaacactgaaaataacccttttcaagatggtcattttcatgaaaccccatctcaaaaatcagctgaaaaatctagtagtgttcaaaatgggaagtatagtcataaaaatggccatttgcaagaaaagccatttccgtcttctggaaaatgcaagtcaattctgaattatggcataaagactcttctttttgccttaattcttagagtttatgactatagtgactatatacaccccatataattatggtcatttactgcttccacatatactttagcttagaaatcattctagccattgtatcgggcttggcccgtgggcttctcgggcttgaactcgaaccgcagttcaatgaaccttatctttctacttcactacaagatttttggggccggcgttggaatctcattgtcactcgtatccttcgcccacggtatacaatccaactttaagcctctccacaaacattttgggccggaagtggccccacttcccgccgtgatggcaacattcgttgtatcgggcctaatgcacgagctgatattttactatctgggccgggttaagcccacttgggaaatcacctggttctttttgctacatggagtgtgtttaaacattgagatttgtgttaagaaggcgattagtgacaggtttaagctgccaacgattatcggacgatctggaccgttggatttgttatgatcactggtttttggctgttttttcctcagttattaaggtgtaattctgatgttagagcatttaaggagtacgaagctattggtgcattctttaaggatgttacaaatgctgtcaattcagcatttttgagacataaacggatctaaaattttaattctatgagttcaacatttaatgttatgggttcatatttattatttattataatttagtaattttttgaatataaattaatacttcgcgttgaaagtactaaattctgtgtccgcctcagttttaagataacccatagacataaatttacttacatttaatgtatttgtaacaaacccatacactctcatagctaagttgattatatttccaatgcaatataatatatttattccatttttatttttttatataacggtatttgatcgtacataaaatctaaaacaatctcaaatgcgaaatgtatcataaaaattagaagggggtaaatactaagtaagttaagtgacacaagagcttcatattacacagatttcttgaaacaacagtagttctcgagatgcaggttcgggatgcacatggggaagcttcatgacgatgtctgtaaagtgaacaatactaaataaagtatttttcagtttaattgtttaatatcttaaatatattgtaaaatcttttatattaatattaaccgataatttttctctattattacttaggttgatacgctttctatattgttaatttatgtgttagtttcttccattttttgagtaaaattcggcaggattttgtttgaactgtcatttttttaagctatttatgggctaatatctactattaattataattttagtaattttttacacataaatttatgctccacgttgaaagtactagattcagtgtcagccctgttttgagataatccatcgacacaaattcacttacattttgatgtatttgtaacaaacacatacactcctatattatatatatatatatatatattattatatatattattaatatatatatttcgatctcttttatataatgatatttgatcgtgcataaaatttaaaataacctcgaatgcgaaacgtatcataaaaattagaatggagtaaatactaaataagacaagtgacacaagagcttcatatttggtatatttcttgaaatttcctatgaattcaattctaataattagaataaaggtaatctcgcatgacaacaaatcttatgtggaaaataaatgtgttctatcatcataaataaaaaggatatccttttgacttgctagtcatgaattttataaaaattggggtgtctaataagaacatatcttaattcatgtgtcaaaatataaaatttcatctattttaaggggccggttatgtatttaaccaattaatttattacatattgatgagtagtgcacatatagtctatagagtcacaatttgctcttaaaattatagttatgcacaagtctggaaatagcgagttagtgcatatgtaatctgtatacggtaaaaatcgagtccattcaattttgctgattatcgaatccaggggatagtttgaggattgatttcgtattatatcatatcgagatatgaggataaggtatcgagttcaggttttgtagtattgtcgagatcgagaccaaacggaagacatcgagcaagaccgaagatcataataacagaaagctgagatatccgtgactagccgagatcatggcggaaatctcggagcggatcaaatcaagaatggttatttacataatgagatttccttctgtaattagaattgtaccataagtggaattcctttactatataaagggggtttaatcatttgaaccatcttattatcgcatatcaaagcaatataatatctttttttcttatactctcttgttcatcagtttatttcatatttcataactctattctcaactggttcgagggctgaattgcatttcaatactgtgttgcgttactttactattaatttcattagtaaccatcgtatttataaattggactaggtaaaatcacgtatatttaaaatcacttataagtttaataatcaagaaattgcttaagctcattctgaattcataagcattcaaaaaaaaatatatcttacagtcgaaggtgagacttacgaccgattaggatggagctaaacattttggtagttcggatgagttcaataatttttatttagacttttattgtgttaggaattcaattaaaaatatactatactatttaattatgaattaaataattacgaaaattcataagacatcattaaaaatctgcttcacaccatgatcaattatcaaaaagacagcggaccccaaatctaggtagagactactaaaggagaaacaattttgcttttaccgttagagtcggattcagaattaaactttacgggttcaaccattaaaatttttaacttgaaacttagtagattcttaaaattatgggttcatatatactatttgtctcaattttgatagatttttacacataaatttatgctctgcatcgaaagttatgagttcaattaaatcggtcacttacgtgctaagtacgcccctgtttactgtacataggtattggatggacccaacaacttaacatctcacgagactttcatgtaaaaatagcacgggctagccagttttcggactggccattcaaaaatagccagcgttgctaagtcattgaaaaatagtcattattttgctgcaactcggaaagttctagcataatatactggagatcggtgcacctgtgtatgaacttccagcatactatgctggaactccaacacgcggaaagttccatcattatatactagagactggagcacctatatatgaactccagcatagtatgctggattggtatattatactggaacttcagtattcataacaggcggacctgggattttaaatttatggattcgaaattctaaccattttaagctactgagttctaaattaataatttatatatatcaataaattttgttaatataaatacagggtcgggtttcgacacgcgacaaatcttttaaggaggtattaaaagaggagagttgcacctaacgatttttaaggtgcgttaggacacctatttgcaaataactttgtttgattagtcaacgccaccaaagatcgggtaagggctcaagttacctcaaagagaaggtgttaaagcactcctcgaggtccacaattgtcccggccgaacttgaattatatgaattagtcagataaacaaagacagagaaaaacaagaagttcggaaagttttattatcaaaagactttgaagtaaatataaacacttgattcaaaaataaaagggataagatgggggtactaagttttttagcctaaatgatcaccccatgcaacataaataatacttcataactcccttgagatagggtgttactcgtattattcagcgggcacagactatcatctcctgctacccgattactatctttaagttattacctaaagcgcactagttgattctaaatcgtgccttatcatgcactacccgtccatacctatggtctaggaggcatttagacctctatttgggtggttctagacttgacttaggttgcttagaaaatgttaaaactaggcgacaattcaaaacaaataggactgcagtaaaattcaattacaagctcaagttagcctccacaattagacaacaaaggcacgcaaacagacttctatgtagggtattagtcagtttcagaattgaggggaattgcagttgttaaactctatagacatagtttctatatgatctgattcagaggtgcatgccattttagacctatgatttctaaattaccaattggtaagtaccagatgctgctaagtcgcttatcacagattataagttgataaatctataggcatgatctctaagtgatttaacacaataagggacaatgaaacttattggaagtgctcaaaattacctatgcttcctaataatcgcgtgaataaacaataaaacaacgtttgaaaagtgagtattaatgtcctataggtatgatttctaaagattggtgattggaactaattctagtacgtttagcttctataggcatgctttctaaagattgacgattggaactgattttatacatttagctcctataggcatgcttcctagatggacgatatggtgcaatagcgaattaattagttagaatcctataggcatgatatctattgagcatggtgcagattaaggagcagtcattagcaattatttcctataggcatgctatctagcaacacgtagcagtagacacaagaatagataaagcacgtatgcgtcgatagtatactaattatgtgagtgtatgattccctaataacatgatttctaataatgcacaaacaaacttaaatgtaataggtcggatagcaagtagatcacacaaatcctataaatatactttctacccttttcatgcaagtattaagagatagtgatttctaatttcactattaccccaattgttattacagacccaataatgaataaattacaaagtggtacaagtaataaaagtaggcttaaaacaggccctaagagatacccagcatgccaggccaactaagctcttcctcaacctttggacacacagatctcaacatagcctagaaaccataggagaactcaaaccaaacccaacagtcagtttgatcataggatccaaaaacaaatcacttacacaaacaatttgcatattcaatatacagaaagagggacatagctaagtagtaatgaaaatgacaaagaatctcagaccctagtgtgtctgagttcacaagagtctcaatatggacctcgagcagtgctcacactagggaggttaatagagaaactttagtggccttggcttttgccagccaagaattataggtttggaatagggtaagtaaccaataatgatcaaatggtagagtttgaagaagtgcatttgcatttttagaaacatgcattgcagtggtgatcacacaatgaacatatcagcaaaaagggtaaacaaacttaaaagataggttgatatcacaagtccacacttagcatattgggcagaggacattttgtatgacgcaaggggggttgtgacttctgaggttacaaaataagcaaaggtgcattatgccaaatagataaaagtagaacgctaacttaacagattcaaagcctaagggtaaaattagttgaacaccataaattaaatagtacaactcacaccaataaggcaaaacagaatcaaatgtcatgaaggaaactcaagttaagaagctattctaaaaggttccaactagtcactaagggatacagaattgggcatctaaagacatactgagtgataaaaatgatcatgggagcaatccataactagagtgaaagtcttaacatagattaggacatattatagatacatgccaatcactatagatatccaggacatagcaagaaataaattgatgtcatatagccaatgtaaacattcaaagtaccaatacattaagctaaacgaacttcagacagtctaaattgttcaagttaaacctaaacacatctcagaactggcaatttaggcatgagaaaatgctagagaggttcatattacaaacatattcgataatagcagggtcgcatatagaaatagtttagaaacagattaagttatgcaatttaaggggtatgaatatgttaatcatgagcacaagcgaatgaatagggaaaaggctaaagaactcaccagttactgattaacaagtagacaaactagaaagaacaaactccacaacactttgaatgtcaacaaagagcagtataacccaagaccttactgcgtcaagttcccaagggcttcaaaggaacccagggcagtgcttacaccaaggaaggtcgaaaataaaattcggtggccttgtctttcagccgggcaagagccaaaagtagaacaaaagaatgaaagaatagcagaatgaaagccttcaggtttttagtgaaaacttaacgattaaagtctgccaaaaagggaatgagggagggtttatatagcagtaaaatcggatgcacaaacaaggaaaataactgattaaacatagataaggaaagaaatcaagtaaacacggacgaagaaaagggaaaaatctcgcatgcaagtcagtaaaatagcagaaaagaaaaagtatcaaactttaaaccctagttaggttttaaactcaaaatcgaccaactggtatgaagaatccagttcatctcgcgtatatggacaggatatcatacaaatcttcaacattgagttgattctcgtccgatatagaggtgatattttccaaaattaggcaaatacctaagtaatatcaaaatggcataacgaataccgaaagaatccatatatggtaaacaaacaaatgtcgaatcccattattaatgggattgggagagggaatcaaagggaagacggctagggtttctctagtgaggaaggaggagagacagagagaaccaagttcgcacttctagccactttaataaaggtgtataattataaaaccatttgcatccaaaaatcattctcttcttttattgcctacacatttacttcgtgctgtagatcatgttgaccacggttcgcaccatggttcaactcgtgagtcgagtcgagctggagccaccttttgatgagccttacaagactagctcgcttcaagatttctgggtaggaggtggaacctcatagtaaccaatatccttcttcccaccgtttacaatcctgtccggtctattatgtcagatcggatcccgagaaagtggaccccacttcctgtcgtgctcgcaacatttttcgtgtctgagctaatgcatgggctaattttttactacatatcaagactaaatcctagttgggaagtcacatgcttctttatcattcatgggtggctttaactcttagttgaacggcaaaattttggttcctaggattatctcaggcccattagcattgggatatataattttgaccaacttttggttgttcttttggttattcaatctgtattgtggtaataaacaattaaaccattaaattttctaaaatataaacagaaacagaaagttagtaacaccagtttaacgaaataaagtctgaaaaatagtataggaataaatcgagcccattgaatgcacaatgtgtccttaagaaattattcccctcaagtacccgagtgttggaatattatcctcccacgatagaaagatttaactcaccagcatattggtaccaaaaactctggtgaacttcgaacacactcaattgtcgtaaaacacactagaaaatattgtacagaacaaaaagaagataatcagaaaatttagcaagtaaaaattatgggattcaaggaatatttatagaacattcggcactgtttttgaaaaggtttgcagcctttcagaacaaccatagttgttgggaaaattgtgggaaataacaaacggatttaaaataatctgagaaagaaaacggaccggaccgggtcgcgggtcatgggttatttcggattgaatttttgttaatttaatttaattaattaattaataattgaaaggaattttgtccaaaaagtttaattaatcaatcgttgaccaaatccatatacgaagccgaagtcgaagccgaagtcgagtcgagcgaccgacaacgacagcgcgaggcttgctttcttattaactctttaagagctagagaagagaaattgtatatatacccatcaaaagtcttttctacctccaatatgggataatgtccctttgccaaggagggaaacttaaatattttatttttcttccatttctcattcaccctctttaagctacaccaagcttaaaagcccaacaatccccacatgaatgggtaatggctataaaataaaggtaaggcacggatgcgtgtgtgttttacatgcaagaattaattgcatctggataagtaggtttccctttgaacttttcatagttaacttatatcagatatactcggtcagtcggtagatttgatatctctgaaccatcgagctttgttgtatacctagacaatataagtcacacaatcaatccttaaccatctatggttctcacagttgtgtttatttcagccatgaacaccgcttggtttcataagtgcttggagaattggactttactttcattccccttgaagaggtttacacttcacattcatataggttattcctaaacgtgtaatcctatagatacactatctgatcatatccttccagacttagcaaatcattaaaaagctttaactttattgactcatcaaaaagtgtaacgacccaaccgatcgtttcgggagttatagtcccgcttcccccattcctgcttctctttgtgttattcagctatattatgatatgtcggggtagttggtttgggcctggagtggtttcggagtgaattaagacacttagtctctttattagaagtttaagttggaaaaatcaaccagatgttgacttatgtgtaaacgatatcggatttgaattttgatggttccattagcttagttaggtaattttggaattaggggcgcgtccggaatgtgatttggtggtctgtattggaattaggcttgaatggcgaatgttgaaggtttggtgattttggtcggcaatgaaaaattttggtatcgggttggaatgaatttctggaagttggagtaggtttgtggtgtcatttatgacatgtgtgtaaaatttgaggttattcggacgtggtttgataggattcgacgtcgtttgcagaatttggaagtttagaagttcttaggcttgaatccgagggtaatttggtgttttgatgttgttttgagtgattcgaagtttcgactaagtttgtatgatgttataggacatgttggtatatttggttgaggtcccgagggcctaagggtgattccgggtagctaacggaaggtttggaacttggaaatgcagctggactgctgctgctggtgtttttccgcacctgtggagggggagccgtaggtgaaaggccgcacaagcggttaggaggccgcagatgcgggcatggttgagttggactggatccgcaggtgcgagaaggggttcgcatctgcgagcccgcagatgcggaagtggggagtttggtcgattccgtagaagttgagggtaaggcacaggtgcaaggtgatgacagcatatgcgaaacctgggatattagatgagttccgcacctgcgatggaaattccataggtgcggcgtcgcagaagcagggacgtggactgcagatgcggtttcactaggcagaatgtataaatagaggacttcgagatttttccttatttctaccatttttaactcggactttggagcttttggggtgatttttgaaggggattcaaggatattcactgaggtaagttacttgagctttattattattagctatggcgttttcttgttgatttctcacctaattagtggggttttgaagtgaaacgaggggttaggcttgggattctagagaatgtaattttggaatttgagggaccaaatgatgtcggattttgataaattttgtatggttagactcgtgggtgaatgcgctttcgggttttgtgacttttattggattctgagacatcatcccggggccgggtttgagtgaattttggattttagttctaattcagtagttttcttgtgggattgatccctttattctttattgattgtgttgtattacttgtggctagattcgggacatttggaggctgaatcgagaggcaagggcattacgaagtaggaatttgctcggattgaggtaactaacggttgtaaatcttgtcccgatggtatgaaaccccagatttttgtgtcatgtgactatttggaggtgacgcacatgctaggtgatgggcgcgagtgcatgcatcgttggggattgtgacttggtctgtcccgtagaaactgtaaagttgaacaacctattgtaattatatgctccttatgtgttttagaaagacttactgtacatcatgatagataccacgtttaggctttatgccggtattgtttggacttttagcggtcgtttcttgctgtactctcactgttttagctgatgttccgtactcagtcatgtcatgcattcttacatcatagcgtctctgttattctatttgatgcatcgtgtcaatgcagtttgagctgattactttgatttctgagagcataagagactggagagattgatgactgagtgaagctgagggccagatttgtgaggacatttatgggatcaggatgcacgctgcaacatgtttcattgattctgccatgattggcattgatatagcgcatgggctgaatgagccccttcggagtctgtacacaccccagtgagcacaagtacctacagagtgcgagtgtcgagtgccgagtgacgagtgctgagcgattgtgaggcacgagtgattatgaggcatgggtgattgtgatgttggagtgattgagaggactgggtgatgttttcccgaggggcggtatatgatttcatcatttatgctcatagttgctttgaatccttgtttaagaactattgaaagattccttaactgatttttacttgaacttgatttaaacaagctgatttgactgacactctggttgtaaagcatgacgtactttactgaatttttgtgatatgaactgtacttgcatttagctcgtcactacttctcagcctttatttacttctatttcttactgagttggtgtactcacgttactccctgcatattttgtgcagatccaggaatctctggccacagtagcggttgttgatatattcaataatgtattattggagataacaaggtagctgcctggcgatcgccgccctgccttttcttcgtccctatcttccccttagtagtattttggattttccaagactatgttagtcttgttattatcagacaagtttgtagtagtttctcatgactcagtgactccctgatgtttggggcttttctttccgcatttctatttttgagttcaactcttgtttctttttaagaaattctgttatacaaaaatgtctttggcatatctttgaataaattatggtagtatttcggaagtcggctggcctagtaccatcgataggcaccatcacgataggtttgagtttagggtcgtgacaaaaagtcttaatgctttacctcgatttttgaacattgtcttcatcaggagaatatgttgagttatttgacaatgttgaaccgtcattcataactttgtttgatctctttgaatctaactcttgggatcttcagctgctaggtagagttaccgccatgatggcttgtcctaggccttaaccccattccctttgatgatctttcaactgcctctctagataggccttttgtaagtggatccaacacgttatctcttgactttacgtagtcaatcgtgacagcaccactggagtgtagttgtctaacggtattgtgcctccgtcgtatatgacaagatttttcgttatacataactctccctaccctgcctattgtcgcttgactatcacaatgtatacaaataggtgccaagggtttggtccaaaatggaatatcttccaagaaatttcgaagtcattcagcttcttcaccgaccttatctaaagctatgaattcagattctattgtagaatgggcgatgcacgtttgtttggatgatttccaagacactgctctaccccaattgtgaaaatatatccactcatggatttaacttcagatgatccggtgatccaatttgcatcactaaatccctcgatcacggagagacatttgttataatgcaaagcataattttggatatgttttagataccccaaaactcctttcattgccatccaatgtatttgattggaattacctgtaaaccgactcagtttgctaataacacatgctatatatgatcgcgtacaattcatgatatatatcaaacttcccaatactcttgcatagtccagttgtgagtcactttcactttcattcttttgaagtgcataactcacgtcaattggagtcttggtaattttgaaatccaaatacttgaacttgtcaagtgcctttttaatataatgagactgtgataatgctagacctttgtggagtcttgtgaattctgattcctaagattacatcagcaactcctaagtctttcatgtcgaatttgctagccaatatgcgcttaatagcgtttatatgtgccatacttttgctcattatcaacatgtcatcaacatataaacaaacaatgacttcatgatctggagtatttttaatataaacacatttgtcacactcgttgattttaaacccacttgccaacattggcatgccattgtttgggagcttgtttaagtccataaagcgacttaacaagtttgcgcactttcttttctttaccagtaaccaaaaaactctcaggttgtcccatgtaaatctcttcctccaattctccatttaagaaagctgttttaacatccatttgatggattttaagaccatacacgaccgctagtgccactaacaccctaatagatgttatcttcattactggcgagtatgtgtcaaagtaatcaaggccttccttttgtcgataacctttgacaataagtcttgccttatatttgtcaatagtgccatcaactttcatattccatttaaagatccattttgaacctaaaggcttatttcctggaggaagatcaaccaattcccatgtatggttatccaaaattgattgaatctcactattggctgcctctttccaaaacactgaatcagaagacgacatagctgctataaaagtttgaggataattttcaagcaagaatgtcacaaaatctggtccaaaggaagtagatgttctttgacgtttgctacaccttgaatcttctatactttgagtattttcctttggttcttcacgaggtcgtttaggtctttcagttaacgactcgcattcagttttatacggataaatactttcaaagaattcagcattatctggttccattacggtattaacatgaatctcgggattatcagatttatgaaccaaaaactgacatgctttactgtttgtagcatatccaatgaaaacgtaatctacagtttttctccgattttaatcctgttagctaaaggaacttgttcctttgctagacaccccacactttgaaatatttcatgttgggttttcttcctctccattttcgtatagaatagattgtgttttgctgtggagtactctgttaagtattcggttagctgtaaggatagcttcccccaacaaactctgcggtaatccggaacttatttataaagaattcatgatttcctttaatatccgattttttctttccgcaattccattggattgaggtgtgtaaggtgcagtagtttcatggataattccatattccgaacatatttctgcaaatggagattcatattctccaccctatcacttctaatcattttgatctttttatttaattgattctccaattcattcttgtattgcttaaatgcttcaattgcttcatccttactattaagcaaataaacataataatatcgagtgcaatcgttaatagaagtaataaaatacttttccccaccttgagtcggtgtcgacttcatatcataaatgtcagcatgaattaagtctaaaggatttgaattcctttcaacagacttataaggatgctttacaaacttagattcaacacatatttgacattttgatttattacactcgaatttaggcaatacttctacattaattaacttccgcaaggttttgcaattgacatgtcctaaacgaatatgccataaatcatttgactccaataaataagaagtagaaattttattcatattgtcaacaaccattacattgagtttgaaaagaccctcggtgaggtagccttttccaatatacatttcgttcttgcttacaacaactttatcagaaacaaatacacatttgaacccattcttcacaagtaaagaagtagaaaccaaattcttcctaataataggaacatgaagaacgttgttgagcgttaagaccttgccggaagtcatcttcaggaatatcttccataaccttcaatattggttgttgcattatttcccatggaaagctcttcttctggaccagcagtagagtaagtcgccaatgcttctttgacagcacaaacatgtcgagtgtctccagagtcaatccaccactctttcgaatttctaactaggttgcattctgaaagcatttcacaaagatcatcaatgtcatcattcttcgctactatgttggcatgtcccttcttattatcctttttcgggagacgacaatcaggggctttgtgactaagttttcacaattgtagcagttgcccttgaatttctttttgttatgatccttagtctgtccagaagacctcttcctcttcttactttttggagcagtctcctcaacgatattagctcccatgatcgttgaatttccacgagacttcttgtcggttgttttgttgtcttcctcaattttgagacgtatacaagatcttccaacttcatttctttgtgcttgtgcttaagatagttcttgaaatctctccacgaaggaggcaatttttcaatcattgcagccacttgaaatgcttcattcacaaccataccttcagcaataaggtcatgaaaaataagttgaagctcctgaacttgggttcccacagttttgttgtctatcattttatggtctagaaacttggcaaccaacaacttcttcaagcatgcatctttagtcttgtacttcttctcaaatgcatcccataattctttcgaagtattcattgtacaatacacattgtacaagtcctcctctaaagtgcttaagatatagcctttgcaaaaaaaatctacctgttttcacaccttaacaatcatgaatttctcgttgttcgacatgtccacagcaggcactggaggttcttcactagtgaatttctgcataccaagtgtggtaagccagaagaacactctttgctgccatcctttgaagttggctctagaaaatttctccggtttctctgccggtggacaacagtccggcttgacgaggctatcgtcgttgccgcaacactcgcagaagaattttcgttaccaattgccgtttcgcattgtcaacaacagaagtgttcaattaatggcaaaaccagaacagtaaacaatagaaattaacaataaacaatacgtatgctaaataaaaacggaagtttttatataccattcacagaaaacaatgaagtttttatgttcttcaaatcattttctgaatttcattactctgatgaagtttttatatcttcatatcagaatagtaaaattcagaaggagtagaaaaccacaaaggttttaatctccacaaacagaatacaaaatataataaaaaataatttccttaagattgttattcaatctgcattgctataataaacaattaaaccattaaactttctgaaatataaacagaaacaaaaagttagtaacatcagtttaacaaaataaattctgaaaaaaatgtaggaataaatcgagcccactgaatgcaccttgcgtcgttaaggaaactattcccctcaagtacccaaggtgttggaatattatcctcccaagatagaacgatttaactcactagtgtattggtaccaaaaatccggtgaacttcgaaccactcaaaggtcgtaaacacactgaaaaatattgtgcagaagaagaagataatcacaaaatttagtaagtaaaaattttggaattcaaggcatatttatagactatttagcactgtttctgaaaaggtttgcaatctttcagaatagccatagctgttagataaattgcgagaaacaacaaacggatttgaaacaatcggggaaagaaaatggattggaccggaccgtgtcgcggatcataggttatgtcattttccctctatttcccattcaccctctttaagctacgccaaacttaaaattaagctacaccaaacttaaaaactaaacactttccatctttattgagggtaaaccagatgttaatggttgtattgaatctcttgctttcttagaatttgttaggtatggtaaactagttaatccttccaatatcacttgtccattcttgtaagattaggttagtttagtcatttagtgataaattgtttatactaagtggcatttggacataagaaccgtaaaatttcggaaaaaaaagtaaaaaaaaattcaagtaaaatgtatttgaaagttagagttgtttttggatataaatataatattgggctgtttttaaagttttgcaagtcatttgaagtgaaagatttgaaaaacagccttttggaattttccaaaaattccgaaattcatttcaagtgaaaattaaaaatttcatggccagacattaagttcaaaaaaaagtaaaaaattaaaaattaaaaaacgaaaaattatgtatggccaaatggccccctaaatgtctgtcaacatcatgggaaatagtagcgtgcaacttaaataatttataattaaaattaaaagaaaaacaaaaataaaaggtcccctaaccttggtttactttagaagaacaatgtgaatttgactttgaccataagaggtgcgttataatatattttccacgtaccattatttgaataaattagtcaaaaatacataatatataaatattctccttttataataaatgtattattgtcagtataggtcggcgattcaactaatcttctcttttttttattatcccttgtggattttgatgatgtattaaatcctataaatgctgttacttctcaagaacgatatataatgcgatagatgagattcattcaaacttaatcgaagacttatggtcaattatttgcaatgcgaaaagacgtactgctatatcagtgtgtaatccgttctattctgggagaaaataattcataacctcgggtataaagaggggattaatttccttaaagaaacactgttgaattcaatgaactcggattaatttttacttcttctacgtttctgtttatacgttgtgttcttctccagaattattttacaatacaatatactaacagaaatgcgctctctctctctctctctatatatatatatatatattagttcacgtttgttttttcgcctatttttatagtttgagtccaaatagacaatattttagttccggactctcgtaattacatggtggtttccgatagactcttaaagaagaaacaaactaactttcaaaattgaccgatattgcttttactaaacatgacaatctgacgagactttcatgattaaagaagaagctgcgaagaaataaaggcagaattcagaatttaaatacagattaatttttataaactcacagttataaaagaacttaatttttacattatatggtcactaaaataataagtataataattcataaaaacgtaagacatctgccacaacaaattagaatacattaatagtgtagaattgttttaaattaaacgtgcatataagtttaattcatagaatattattatatatagctggttttaaaaaaaatttgattacattgaattgtctgttgtgaaaaaaaattagaactcctttatggattgtagataccttgatcatgtgtaatagggtgtacatggtcggtgttgatcaataccaaaccaaatcaaaccaactgtatcggtttgggttggtccggttttgtcagtctttttggggtcttcggatttttttgttacataaaaattatttcaatcttactttattaaagttataaataaatttttgataagtgaatatatggttagtaaaaatagaaaaaactaacaaacatatgatcaattaatatattattatgggagaatttttttaagggcacgggatagctgttttcttagtcgtctaacaattattattcattatgtacgctttaatttcaaagttaatcgaattaaataattaaacacacacaaaaaaaaaatcaacattaaacataaataataatttgttctatttaatttaaagttattaaaataccatttcaaattcgaagaacatataagaatttaacagattttgacatatgaatatgaaagaacaaagagattgatgcatttcagtaacacttgatcagaaagtgacgatccaaccattatttaaagtaaataaaaatggctgcacttcatagttctattaaagtattacatcccatgagataatctcaaatatttctagatattttataaagaaagttctatataaagtcttaaaagtatatataaaaattatatatttatatgtttgtttggtttgaatttttttattcagtaccaaaccaaatcaaactaaacctactcgaatttttaatcgatttaattttatttttcgatttggtacggttttcgagttcaatttaaacaaccctaacgtgaaatatgtctgtcatataatcattaaacatatcttagatgaagactaatctaattatgtgaatcttttccaatcccacctcaagatgtcccctaagtcaaccatcattgtatgtatttttattaaggttttaaccacccaaaagagcacaaaatcaagtttaaatcttgtaccaagattgcacttctagccattttgataaaggtgtataattataaagaccatttgcatccaaaaatcgttctcttcttatattgcctacacatttatttcgtgctagagatcatgttgaccacggttagcaccatggttcgagtcgtgagtcgattcgagctcgagccaccttttgatgagccttacaagacgagctcgcttcaagatttctggggtaagaggtggaacctgaaggtaaccaatatacttcgtccgaccgtttgaccagcttttggctattctttccacctttattgagggtaaaccagatgttaaaggatgtactgaatctcttgctttcttagaatttattagtccttccaatatcacctgtccattcttgtaatattaggttagtttagtcatttagcaatgaattgtttatactaagtgggcgtttggacaaaagaattgtaaaattccaaaaaaaaaaaaaaaaactttcaagtgaaaacggtatttgaaaattagatttatatttggatatgaatttaattttggtttgtttttgaagttttatgggtggaaattttgaaaaaaaaaaacagttttttggagttttcaaattttagaaaaattcaaaattcatcttcaggtgaaaattgaaaatttatgaccatacattgatttcgggaaaaaatgaaataaaaaagttaaaaaaattcttatgtccaaatggactctaagtgggcgtttggacattagaattgtaaaattccaaaaaaaaaaaaaaaattcaagtgaaaacggtatttgaaaattaaatttgtatttggacatgaatataattttggtttatttttgaagttttgtgagtgatgtggaaatgttgaaaaaaatagtttttggagtttttcaaattttcgaaaaattccaaaattcatttcaagtgaaaattgaaaattttatagccatacactaatttcgagaaaaaatgaaaataaaaaagttaaaaaaattcttatgtccaaacggacaataaatatctgtcaacatcatgggaaagagtagcgtgcaacttaaataatatataattaatattaaaaagaaaaaaagagtctcgtaactttaggttacttttgaagaataatgtgaaaaaaagttctctttttgtaccactgttatggatcttgatgatgtaataaatcgtataaaaataatatctacagataaatattaatcttttttacaaataattaaacatatttgaattttgaaattatgtttctttcatcatagttttaaatgctatatgtgttcaaaattcataagcagtacttattgttatatcgttatttctcaagaacgatatatggtgagatggatgagagcccttcatatttaatcggagccctttataaataagtgtccatttatataatcgagaaagaattcaatttatttttacaaaataacccttatgtacatatccctaaaaagttttcttactcctcacattaaatatttaattaagggtaatttagtcatactaggtattttgtatagaatttaatattttcttaacggacgtgtcaaaagcaaattgatcacttattatggaccggagaaagtaacatttatttatagtacaagacaaatacgatgttcaacagtaggaaatttcacatggcattcaaattaattctatcatatcttatacaaccttggtattaaaggagaagaacaattgtacatgtgaaagttagctagacatggtccatagtcatccgctcaaacaacaaaaacgacaacgacgatccagtaaaatctcacaagtggagtctgaggaaggtagttagagacggatgcagtgtggtggttatgggttcaattgaacccgtaactttcgatgcggaagaaatatatgtgtaaaaattcattaaaattgcaagaaaatagatttgaacccttaactttaaaatataataggttcaatgttaaaaatcttaaaagttgaacccatagagtttaaatccggatctgcctctgagggtagtgtgtacgcagaccttacctaacctgaaggaatagagagactattttcgatagagcctcgaaaaaagataaattattggtcgagcggtcaaatatgttaaaaaaatcaagatcttacaagagtggacatatcatattagttggactaactagtttcccatgcttgaggaattctaagaaagctagagattcagtacatgctttaagctctgtttgaccctcaaaaatggtggaaagaagaaccaaaagctggtgaaaattataaaagctaatgctaatggtcctgagataattctaggaatccaaattctgccattcaacactttcttgatcacaatttcaagagccaaagccaatccatgaatgagaaagaagaccatgacttcaccactaggcttcaatcttccaatgtagtaaaaaatcacttcatgcattagccccgagacgaagaacgtcgcgagaacagcaggaagtggggcccacttcctgtggatccggtctgacattatagacaggacaggatcgtaaacggtcggacggagtatattggttaccatgaggttccacctcttacccagaaatcttgaagtgaactagccaagtaaggctcatcaaaaggtggctcgagctcgactcgagtaacgacacgaaccatggtactaaccatggtcaatatgatctctagcatgaagtaaatgtgtaggcaatagaggaaaagaatgagttttggatgcaaatagtctttatagctatacaccctaatcaaaatggctaaaagtgcaatcttggttacatgattcaaagttgaccttgtgctctttttggtgtttcaactttgctaattgatggtttttgaaactttataggcaaacaagccaagggaatgaatgttgaaagtgacaaagatggggttgatgacaaagggccttgaccaaaagcaaaaagaagaagcttgaaattggctagccatgcaatgaagaaagaagtagtgccaccaagattgatagaggtaagataaagaggaagaatgaaaataggcaaacaattggaattatagcaagaaatcttgatttgcctttgggaaaaaatttgacaatggtatgagagtaacataaacttattaagataatagcccatactactatgaaattgtggatttccccttccatttctcctcctcttcttcttcttcttgaaaatggatctcttttcttcttcttggaaaaggatttagtagaaagagatgcctttggttattttctaataggaaaaaacatattatatgatggttgacttagaaacagtgtcggagtcacatgcaatcaagggtgtcaaccgacacgccttcgtcgaaaaattacactgtttaactcagtaatttaaaaaaataatatgtatatgtactatataatgacaccccttaacttcttggtaaatttattttattgtattttgatccgttaatgaaaactctggctccgctacgagagatgtgaagtggggtttgggaaagatggcatctttcacataagataaataagtagttgtcatctaagatacgtttactaatttggaaatatattctgcacacgatcaccgcaatctgtctttttggaaattaattctttgttattctttttctgtctaaacaataaaggatttaagttatccatattaacaatatataatttattttcactatcagtatactttaatatgttatagttggtcaatttatttttttatgaagttactacttgatatttatcatagaaatttacttgtcattacattacaagtatctgattgtgtaaatattttttttatcataactacaagaaattaaattctggtaaaataatacagaaatctttatagactcaatattttattcaaattcatatggtgacaagagattatttcttgaccatactagttatccaattaaaatgggcaaaaattacttttagtctgcagctaaaactatttacattcggtagccacaaaaataaataatatttatatattttgtcggcaattattttgagagcaactatacaatgtcattttcccagttaaaatgttgaactctaggcccatttatcgacacatcttattgaagcattgttctttttttttttgaagaagaagaaatataattttattgataaataatgcaggtcacttctgttaatcctttgattctttcctcgaatttgttacctgtaattcatgggccttaacggtatatttctcgaatgtaggatgatgcgaacttccttaattgggatgtatttgatacccgtgaaaaggaaaatactctgttgatcacttcgacggttttgagaaagacaatatttgatgcatttgatctctttatgatatactcataaatttttacgaaatttcgagatcatatatgcatattccaaaaatttatgaaattattgagatgatctctattttcgagatatgaagcattattcattgttaatgaagtggcaaagcattaggcaatgtgcaggacaaggtcgtcaacattaaagaccaaaacaagatgatgagtcactattgaacaacccaagacatggccctacttcaattgtttggagcaataaatggaaattaatgctcttttaaagaccagttcccgagttcggagaacagtcgggtgtacaaaacatcctacattcatgcaggattcagggaaagatcatatgcattcacgcagagttcacggaagaatcgtactttaggagtgtaatgtagatcctatcctaatgcaagtattagtgttggactaataagattatcaaaaaggtacgtaggcagctctcctaaaaaaagtgaagttccgccgcgtttgaaggctagctcctgcttcggagcttcatccccacatctcacatattggaaaaggcaaactaaaaaggggaactcagtcaatagacaaagaaaaaaacggtagttgaactcgcttcattaaaaaataatattgtgatatgtataaattaggagtaaagctgcgtaaagtttgtaaaaatattttatttgaactcagctgacaactactatttttacgattaaagttagtacttctaagattgaaccggcttgcataaaatcctgggtccgccaccaattccagattcgcgctgcataaggtgtttagcccattaaagagagaagcgctccctaccatatgtcatgtaattctgtcacagacaacattaagtgacaaatatacagaattgatgacaaacgactggtaatctacagaaataatcacttattatttcaattgaaaaggaattaaacactaacatgcttttgctattgtaatatgtaaaacaagatataatatacatcaacagaaaactgagtttatgtacctgataaaatgagctgattgttgaactcctccagctaacacttctcagagttgcttcttttacatacctttgatcaatgtcacaacaaatcattcaagattgtctatttctagaggtaactttcgccctttttgtccgtcctgatcaatcaactatcatatttaagatgcattagcgaaacaatgatcttttcgattgagttttctatgtgagacgcattgagaagatgtattgagtagcttgcaagattgctgtaccgtcagtttatacatagagggatgcttccacgatataaacgagaacttgtcaccatatcgctccattccttccaccagcaactgccaaactaaggctcctgcaccagctttcttcttctttgctgatttataaatcttgtcgtaaactattttcagataaatgtttctgtcatgtaatccttccttttgtgtactggaaggaaacccgacttctgtaaaaagaacaggcttcttaaggatctttcagcttcactaatgtgagaatcaaccaaatgagatagaaaatctactttcgcgtctgaatttataccttggatcctgcaacacaacatggtttaacggaatcaataaggaaatagtgataaacgcatatctttttgctgtttacgctgcatctttttgaaagaaaacaagcttaaacttctacatatagtactactactactaccaccagatttgggtacgagttggaataaatttattctgctttgaccaaccaactgtggggtaagcatgaatggaagtaaaatcgatgttgtcaatggcggagttttcaatgaagtccactccaagtgatggcagcccatttccctgggttcgctccaaagcttccagttttttccacaccataaaagccctcgagtccaacagtcacgagatgcttctgatccaaacttttgacaaatccagccatctcagttatccacgcctgttcacaaatcgccattcgagctaaacataagaaggtactagatgcatcatgacgagtgatatcggtttatgcattgtcccagaaatcttgatatgcggactaatcatagtaattaacagagtcataagtaagattactgtaaatccaggtgacatgattgcaagtgtttatctatgtccgatgctttattttccttgaacagggaatttaaaaatacatgcggaaaacaactatttttgctagttgaccaatttcagtacacaagattgttccacctgagagcccattatccactcttgcttcaaaatctcatttttccagtgtcgttgagaggttaaatctcaattgcaagcagtataaatcagaaaaactcacctgcagagcagcagctgatgaactggattcacaacgtggttcatttatgagttcccatgcaaatatggctggttcttctgaatatttaactccacttatggagtttttccttgtcacaacagcctgctatgagccaaaaagaataatgaattataatgtgctagcgcttattgccttatttcatcacgttaacgtaaatagaaagaagttgcttaactaagatatatatgttaaattaggaggttagttagtttacaatggacataaattttagtacaatctcagtagcatacaagaatatgaataattgaatagaactatcggaagttggacgtgggaatgcatcaaaagttgctgaagttttcatcgcaaagtgcttttatagttttatgacgcccctccagaagaatttcaatgatctaggtatttttccttagtaattagaataggtaaaccaaacaatggctagtacactatgtgcccaaattcatgtcctctttgctttgattgatgctttcacacagtgaagacccttgtaaatggaaaacatacattctagaatggcataagtttcttcatttgaacataccttgacgaaagacttgtagtacgctttgaccgttgggttggtaaagaatgaatctcttgatgaagacacattggtaccaccttcttcttgtgcccacctcacatattgagcagtgccaccataagcatttaaattgtttacaagactgaggattaatctattgttatgcttccttgcctcaacaataacataatccaatccctgaaattgataggataattagactatatcaaaatgcgaaaaaagggtggcctaaaattgcatcattaagaaaggccatgcacaataatatgtaacattacagtaagataaacagaattatgtgggcatatgcttgcggatacagcaacaagacaatcgtcagaaattgcaaatgctatattataatgtcttttttctactgtggtctactaatctgtggtttctgttgctcctttctgtagcctttttatggcattgtatcgattattcaacaaagattgaatataatgaattttgagcaaatactacaaaaaatttgtatcttcggccatctataacgcattccactatcagcacaaaactcagttgcttggatctgcataatagcagtcagtactaggttctcatgaattgtgatatcatagtaaattatgtatcagtactatcattatagaaaatgatatgctagatgttttggttgctagatgtagcgctctagactactggaatgttccagtagtcttttaattgatgcgctttatgttaaacaccaaaagttgagtccttcaatgtatttttgcataaatcctatcagtttaaatcatgacataaggcgagtccatctatagtgaagccctgctagcttttgaatataactgaatatccaaacctgttactccaccagctacaactcctcacaattacaacagggtactgaataagtcggtcgattattcattattttctataacggaggtgtttggggcaatttgcgtgcacctatacccaacttagctagttagctccgcattgtgaactgagtcggaaagggcatatatctctcttttgggttgtttccctcgtatatgacctatccgcgttagccctcccaagcgacaaagagtgacaaagaggtggatcatctgatcttgaaataggtcatcccagatatcccgatctttttatgtgttcgtcaggtatctcaattgttctacccactaattttacgcaaatgagaaaaaaaaccatctagcgttttttgtctctgctggaatttgaactatggtcttccgtaattctcatcctacttcattcatagctaggtcacacccttcgttactagtcgattattcacttacgattaaggtgaagttagaaatactaccaaatgttgcagcatagtatttaactatcttttacaaagactcaacctttatcttctcttttcactaaacttttactaacataggaacttatctctgtctcaagagaaacaaatcaacctcccactttacaccaccataacacaatgaaaatcagaatgaaattagatacttgaatgagtttaataagttgctacaaaagtatttaaaaaaccaagggcagcacggtgcactaagctcccgctatgtgcaggatccgggggaccacaagagtttattgtaagcagccttatcttgtatttctgctgtttccacgtcttgctgtgaccttctggtcacgtaacagcaacttcaccggttatgccaaggctcctctactacaaaagtatttcaataatccaaataattgctataaaaacaaacaaacttagaagtgaattaccttaaacactctttcattgaagacaccaggtaggagctgaagatcattgggtccaccaccatcactaaaagcccaagtcctacaaacactcgagcccatttcagcacctcttctcaatatctcagagactctataccttgaagattcccacacactttcctccattaaccaataagaattccacccattaatatacaattcttgtaaggttaaagaatgagtctttgggtcctcattcttgatcacaaattgagttttattaactccaacgaaacccatctttggttgccttagaaagatttgtggaaggaaaaattaaggttgtacttgtcattgaagttctataaaagagaaagaatggtgaaaatgcctaatgctggatatagttttttgtccctccatcgtgtgtccatttgggaaagtttgttggttgttttcttgttcagtgttagttataggggctttattattttaagcacaccactatctcaaataaggcgtaaactatttttcccaaaaaatgagtaaaaattgcacgaacatcctatctggtcacttccatttaacttatatccatatttttaaaattatttaatctataccctaatttttagaacttcaggcgcttcttcttcctgctacctgtgcgctcctttcttcctgccactattctgatacttccaactgattcactagcaacttgacttgcatcctcgtataatttctgcagaaatattgcactttcattaagaaaactgatattgtaacttttcgttagtacagacgtttggagctaaccttaggtatcagcaccaaaaccattaacgtttcatgtgaagatatccatttaatccaattagaggcacctaactatcattaagatgccaattgctagttgttgaagtcctataatttcagctaaaatatgctgaaattaagtaaatatagaacaaaacttcagctagtagaatgtttaagtttagcaattacaaacaaaaacttcatcaactattacgatgaatacaaaaaacttcagctaaaactgttgaagttcgcaagcaaaatagagaacaaaaattcagctagtacgactgtaggacaaaaacttcaacttatttagtgctgaaatttttacaaatgaactaaataacttcagtatcttctgctgaagttttttgaaaaagctttataacaaaactaataaacccaggacaaaacttcagcttatttagtgctgaagtttttacaatatgaactaaataacttcagtatcttctactgaagtttttgaaaaagctttacgacaaaactattgtatacaggacaaaacttcagctaaaacatgctgaagttcaacaaatagagaacaaaacttcagctagtagaatgcttaagttcagccgtctactagaatgctgaagttttgcgtgattgcctttgctacttcaggcccgtatgcctgaagtttaggcgaaaagtgggtacgcttgtaattttttttgcaaagtgggtataaattaaaacgtgacccaaaaagcgggtatagatgcaaatcccccaaaacataaggattaggtggtaaaatttgcatgggcgcctatttggtcgtccccttttaacttattcccgtttgttttttcgtttgcattggtacccattttttgttaaaagaattttaaaaagacgattttgcccttcaagactattgacaaaatgtagactgcaggataaaacttcagcatgttttgatatgagttttagcaaattaattaaataacttcagcatgcattagaaaaaactcattagaaaattacatatggcaagacaaaaacttaagcatgtttagtctgaagttttagcaaaggaattaataagcttaagcatgtttaatttgaagttttcgcaaatgaactaaagaacttcagcatgtttaaagtgaagttttagcaaataaactaaaaaacttcagcatgttttgactgaagtttgggacaaaactcatgacaaaactgtagactgcataataaataacttcagcatgcattagcataaagttttagcttcaatgtgaaacaacttcatgctatatttaccatgaagttttagcttcaacatgaaacaacttcatactatatgaatcaaataactacgaaaattcagaagacgtaactaacaaatcttgactcaacctctgggtcaattatcaagaaagacagcggacccccaaatctaagtagagactactaaaggagaaataatttgcttttactgtcgatccataatttaaactttatgggttcaaccataaaattttttaatataatacatagtatatcttaaaattatgagttcgtatgtactatttgttgcaattttgatagatttttacacataaataaaaatttatgctccgcataaaaaattatgggttcaacaacttaacatctcaggagattttcatgatcaaacgagaagctgcgaagaaataaaagcagaaacagactattccatattgaatccgcaagagggccaacaacaatcaagtacattgtacatggtaacacagacacgaattcagaatttaaatacaatttaacttttataaactgacagtataaaaagaattagttttgcactatgtgatcacttaaatgataattatatttgtttatttataaaagaatattaactctctaatgtggtttgcgagctataatactgaagcatattttacccaaaacgcacctgaagcgtagcggctgcggttcctagtttacaaatcaaaaaaaaagatcagtaacctaaacaatatgacgcctgctacaacaaattagaatacacagttagcgaaaaaattgttttagattataagtgcatataatatagtttaattgagtcaattactcaaatagtcacttaattatccaaaattatcttctaaaatcacttttctttcgtttgtaacaacaaagtcactaaactatgcctattgcactcagaaagtcactcaactagatttttcaaattttggattgccaaatacctagtttaccctctaatttataaatatttttctttttattttttaaaactttttaatattatgatttttccctttttaatttatattatggacttatctataaaataaataaatattattatatattaaaaaaataaaaagtatttaagcatatataatgctggaataacaaaataatgagcatagtaaaaaaattaattagaataatttgtttgtaataataatttagtattaacaacaaaacttcaaaaatttatttgcacaattcagaatgaaaagaaataaaagttgtaaaacatatatttcatacacgtaatataaaaaataattacttaaataacggtatttttataatatacattatatattttgaaaattatgctcaatcataaatttttatatatatactacaacaaaataattaaggaagtccacagtaatagaagtcaacaaaatcctcagctcaaaacaaaggaataacaatagggaatctcccggaacaccgtcctatagtcccaaagtagatatgcagtacaggtggatctcccgaatacgtccgtagttccaaagtaaaaatgcagtgctggggatctcccgaaatacgtccgtagtcccaaaataaatatgaaatacaggggatctcccggaatacacccgtagttccaaaataaatatgcatgttggggatctcccagaatacgtccatagtcccaaaggaaatatgcagctcaaccaatgacacaatagttatagcatcgaagtttacagtctaggctaagtgcaactaaggaaaaacaagagtttcactaaacatgctgcacagaattcaagtagacagtcaaaacatataggcatgcttttctaatataaacaaggtaattatacacctactggtgcagttcaaacaagggaaaatatttatgatttaatgaaaaacggagaataccctgtgtatgtactcgtcacctctcgtacatgactctcatatatcaaacaataccaaaatcctaaggggaagttcccccacataaggttaggcaagccacttacctcgaaccacgctcaaatcagtctgaaaccacgctcttgccatgagtatccatctccgaatggcccagatctaatcaaatcaattacataacgtaaatatagctacgagtaactattttagctaatgaattcgaagctaaggcaagaaaaaaggaaaacgttccaaaagcctccctgggcccacgactcggtttaagttaccaatttagaagactcattcactcacgagatcactcgtacaaaaatcatctaaatccaatgtctaaaacccattcaatacttagaaattcgattggggaacttttctcgccaatttcccaacttttacatccaaatccataattaaatgagaaaacaactatagattaatgacatacaaccaaaaacaagttaggaattgttaccctaaagttttctctgaaaagccctcaagaaatcgctttctccctagctcaaaaatcaaatttgtgtgaaaatgagcataaccctcgattctgccccttttctgcccaacgatcttcgcacttgcgggctgtgggtcgcacctgcgacgccacacctgcggaaaatccctcgcaagtgcagaaatcacttaagggggccgcacctacgcgtgcgcgcatgcggagcactgtgcgcacctgcggtcttcactgtgcctgcaaaaccttgggcgcatgtgtgagtatcgcagatgcggaacatcctctcacctgcgacccgtggtcaagtttccaacttccgcgcctgcggctagtcctccgcacgtgccagtcctcacctgcggtctccattccgcaggtgcgaaacaccaaacaccagaaatcttcagcaactccctaagtccaaaaattcatcggttaagcatccgaaacacaaccgaggccctcgggacctcaaccaaacatatcaaccaatcctaaaacaccatacagacttaatcgagcctccaatccacattgaacaatatcaaaaacatgaattatgcacggattcaagcctaaggactttgaattttccaaattctgcaaacgatgtcggatcatatcaaaccttgtctgaatgacttcaaattttacacacaagtcaaaaatgatactacagacctactcccacttccggaattccattctgggctcgatatcaaaatttcctatgccgaccaaaatggccaaaaatccaactttcgccaattcaagcctaaatctactgcgaacctccaaatcacattccggacgtgctccttagtccaaaatcacctaacagagctaatagaattatcaaaattcaaatccgaggtcgatacccacaagtcaacatccgatcgacttttcccacttatactcccaaaataagagactaagcgactcaattcgtttcaaaaactcaacacaaaccctcccagcaattaaaatagcagaataagatatgagaaaagcagttaataagggatcgggaatctaactctgaaaatgaccagccggttcattacacaagtgtaagaataacttttgtacaattcttcaagtttattcaagagttttaggctaatcagctatgatgttattgtttcttcatagtgttgatatgaaggttgttgaagtgaatagactaggtggtgatgaatttcaagttcctgcccctcttcaatggggtgcacgtggacttcgaaccgctaggtattgtcattatcattggtaaattctcctagggtagattagaaatcgcttgctaaaatgtttttctattaaacaagttccttgtggatgatgttgatgtggccgctggtgctggtttggtcgctggggttggtgtggcttagtcaagggcgtatgcaggaatttttgtaaccgtgtcaatatttatagaagtacaagaataataacttcaattatcatccttctagacaagaaatattctcttttaaatatttgcaaaataataactctaacctattagagcaaaataaaacatataaccaatgcatcaagagataatttatgtcaagtagtgccattttttcttacttatccattttcttacaatatctataaatatatatatatatagagagagtgatatcgcatgacaccgcttcattgagagtgcatccgcccttgtgactagtgaggctgctgggccggtggagctgggtctgatacagacattgagtctgtagcatcgccacgggatgacaaaattggtgatccagattatcaaccttgacactatgcacatgttagcccagtaccagtccattgttttgagcaggggtgtatatagaccgagttagttcaatttttttcaaaatcaaatcaaaccaactatatcggtatggattggttcggttttgtcggttttttcggattttcggtttttttttgttacataaaaattattccaatcttactttgttaaagttatagataaagttttaataagtgaatatatgtttagtaaatattaaaaagattgacaaacatatgatctattaaaataatctaatgggagaatttttttagtaatatatgatagttattttcttagtcgtctaacaataatttttgttaatgtacgctttcaaggttaacacatgagaggatcccaaatatttcaatatttttttaaaaaattcaatataaagtcttaaaaatatatatataaattatatatttatatgtcggtttggttcgaatttttttactcaatatcaaaccaagtcaaaccaaacctaatcgaattttttaatcggtttagtttgattttccagtttggtacggttttctaatgcctctccattatttttttatctatattctatactgccttttaatagttgtacttaattgagtacgtactgttattctactctggctgctattatctttccattgctctcattatggatactgcattttctatttatttttttattcttgacgtattgtgttactgttccattcccccttttttatctcatcgtgtttgagtttcattcgaaaacagtctcttttataagtgtctggttgatgttattgttttgttgttattatattcataagacttactttcgtacggcataaaaacgaacaatgaagaatatttcttttgcgttggtttctttcgaaaacagtctacgacaatatctcatatccattatactgggttgatgttgtttgtgtattcatgagtcttacttttcataaggcatagagacggacaattaaaataataaatgcaacacgagttggaactaaccatgaaatgatcaaactagcttgaatcacaataaagtaagatactttgtcaattctaatataacaattccaattttttcttgatgagataatagttcattcctgaagttttaaatataatagtcacacatatgaagttatatatatatatatatatatatatatatttatatatatataatatatatatatatataatagcaactaaaatattaggatagacgcagtaactccgtagctatagagcccgtttggattgggcttttaaagtaattttaagccaaaaaagcttttaagccataaagttaagaattctagtttttgacttttggcttattttgttattttagcttaaaaataagtacttaaaagcactttttatttcatccaaacactacaaaatgacttaaaagctatttttactttaaagcacttaaaataaaccaatccaaacggcctatgtggcaatccaaaagataaccgaggcttgaaaattcgaggcaatgaaagtaaaataatgggtataatgcaaagagtttgaaaatatttaatatttttgtacgttagaattctttgtaattttaaatttaaagtatatcggttggttttgtcaaataaagtcttttaataatggacgtaaaatctcttgttggcaataaagttactgatttgattttcttaataaaagagacgttatttttttttttacctaatgttatttattcaaatgattttacatttttatacgttatactaaagcattaatgatggctgaaggctaaaaaagtccatcaatttacaagggtattttcgtgcttcattcttactcttggacttcatacttataatataaaaatccatcaatttaaaaggtaattgaatatctattttacgaaggaacaatgaaacttatttaatgagagaaattttatgtttaatatataataattatataaatgtcaaaaatattattacattagcataatacatgaattcaaataaaagtatatcatcaatacatatacaaatgatcactcatgtttgttagataattatgtattatggttttaaaagtttaatgtgatggtatctttacaaacttctttgtgaataactttttttgtatatttccttctaatgctttggttgctttgccttaaccataactcttgttgtcatcttgatatccttcttgatagtgcaacatacagttatcgtgatagaaaatatatgcggcaaatatagttaaaaaacataaacatactaaatattattttcacacaaatttaaaagatattttttagtttcggaggacgaaagttgaattcagggataagaatatacttacacaaatgattgatttagttatgttagttagaaaattatgtaattacatttaaagtatttaatgtgatggttttaacttagtctattgtgaactaacatatgtaagtaataaaacttgacaacagtaagcgatattggacatacgtatcaaacagaagaataagtaaaatggtgcattcgtatggattctgcaatcgagttaaaacactattggatcaaaattgggtcgaatttagtgaatacaaacggacgagttatggtcgaggtcgaagtcgagcacgacttagtgcgaggagtcccaagagagagatcagtgcagagatcgagtaaagaacaaatagcagcaacaactaaaatagtcttagaattatgaaaaggaatattcaattgtactttttaagggttttctaggaatatcccttataaataggaagagatagggaacaaaaagggatcttcacttttctgataagaacatattgtaaaggattgactatcaaaacatacaaaaagctgacttgtctgctgatttcattttcaatatacctcatttattcacaagattcaagataatttatctatcttcagagtctattgtcacgtgatattgtcagaagaaggaatcatccaatcattaacatttgggtgataaattcattcttattacatttaatgccattattcacatttattgcatgtttttatcatcacattcagtaacaatcatcgaacacttactttgcattcactgaccctagacacggtcccatatcatcgagatattcaaacttcagatctaggatttattatgtttaactaggattcatctattatcttcttattaaattagtttaacaaaaagatttaaaactttttggtcaaacaatttcgccctctcgtacggactgggccagtacgaattgcattccagccgaagcaactgcccggcggaatgcgggcaccggagccttcgccttcttggaatctcgcagatctagcacaaaaaggaaatcatgttaaaagaggacaatgaagatgaaagggtcgtgaaattgagaatcagacttactagtcaatacacattctcatggaaccaccttcttcttcacaaacaaaaatataagcatatataggacagcccaggcaccggctgtgcctattgttttcccaggtcttcaggagaccttggagcagattctgaccatgtgcaccattcttgcacaggcggtcgttgtttctaatacatccgctacttctcaggccggggaagacacccagactcctgccacccgcacacctgagcaggtcattcagggacttcaaacaccaggggcagctctagcccagccggttgcacctgttcaggactatgtggtcccagttatggctgacgatgagcagcgtaggttggagagatttggtagacttcagcctccgacattcagtggtgccgagggcgaggatgcccagggtttcttggacaaatgttagagaatgcttcgtgcagtagggatattggagaccaatgaggtctcctttactactttttagttctcaggagctgcatttacttggtgggtgtcttatgagaggcgtaaaactgttgtgcagcgcccttacttggcagcagttttctactctcttcttagaggatatgttccacagtcccgcaaagagaagctgcacaggcagtttgagttgttgcgtcaagatgagctgactgtgatgtagtatgggatgatgttttcagagctagcccgtcatgctactgaattggccccttactgagagagagaggatcgggaggttcgtggatggactcacctatcagctccgtattctaatgaccagagagagggtgtcggctgctacttttgagcaggctgttgatattgcccgagtgattgagtcagttcgcggccaggagcgagatgagagggaggcctcgaggttctggcagctttagcaatgttccctccaggggtcagtttcagcatagcagtggccgcccatttaggcctactcatccagttcacccagcttatagtggtgaatcatcggggcatagtcctcgtagttctcatctgggccgctctttattcagtgcccttccagcctagagctcatcccgtgcaccatcaattcagggttcatcgatgcttggttcttctagtggttatcctggtgttaggggttcccttcagtccccgtcttcagctccagggagttatttcgagtatggagaatttgggcatgtgtggaggcagtgtcctcgtcgtcatggttgtccatctcagcagaggggtcaaccctcgacttcagctccagttacctcaccacccgcccagccagctaagggtggaggtcaggcagctaggggccgccctagagggggaggtcgatcaagtggaggtcaggcccatttttatgcacttctagccagaccagatgctatggcctcagatgcagtgattacaggtatcatttcagtttgtcaccgagatgcctcggtcttatttgatcctggttccacgtattcctatgtttcatcatattttgcccactttctagatatgccacgtgagtccttagttacatctgttcatatgttgattccggtgcacgatactgttattgtggaccgtgtgtatcgatcgtgtgtgatatctattaggggtctgaagacccgaatggatctgttattgcttagcatggttgactttgatgtgatatagggcatgtattggctatctccgtgtcatgctgttctagattgtcacgctaagaccatgaccttagcgatgccaggatttcttaaggttgagtggagaggctatattgattatgtgccgagtaaggtgatttcatacctgaaggctcagcgtatggtagagaaaggggttcatcttatttggcttttgtgagggatgtcagtgctgaggctctcactattgattctgttcatgtggtccgtgattttctagatgtattccctacagacctgccgggcatgccgcctgatagggatattgattttggtattgatttggtgccaggaactcatcctatttctattccaccgtatcgtatggcaccaacggagttgaaggaattgaaagagcagcttcaggaactcctagataaggggttcatctggcctagcgtgtcaccttggggtacaccggtgttgtttgtgaagaaaaaggatggttccatgagaatgtgtattgaataaaggcaattgaacaaggttacagtcaagaatatgcatcatttgcctcgtattgataatttgtttgaccaactttagggagccagggtgttctctaagattgatttgagatccgggtattatcaactgaagattcgagatttagatatttctaagacggctttcaggacccgttatggccattatcagtttttagtgatgccatttgggctgactaattccccaacaacgttcatgcatttgatgaacatcgtgtttcagccctatttggattcctttgttattgtgttcattgattacatcctggtatatcctcatagccaggaggagcatgcttagctttgagagttgtactgcagagatttgaggaaggagaagctttatgcgaaattctccaagtgtgagttttggcttggcttagtagctttcttgaggcacgggtgtccagtgagggtatccaggttgatctgaagaagatagaggcggtgcaaagttggcccagactgtcctcagctacagagattaggagctttattggtttggcgggctattaccgtggctttgtggagatattttcttctattgcttcgcccttgaccaaattgacccagaagggtgctccgttcaggtgttcgaatgagtgtgagataactttcagaagctcaacactgctttgaccacagctgtagtgttagtattaccatcaggttcaggttcttataccgtatattgtaatgcctcgaggataggcattggttgtgtattgatgcaggagggtagggtgattgcctacgcctcgtgccagttaaagactcatgataagaattatccggtgcatgatctcgagctagcaaccattgttcacgccttgaagatttggtgtcattatttgtattgggtgcattgtgaggtttttactgatcaccgtagtctgcaacatctgtttaagcagaaggatctgaatttgcgtcagaggagatggttggagcttctcaaggactatgatatcactattctatatcattcgggaaagccaatgtagtggcagatgccttgagtcgcagagcagagagtttggggagtctagcatatcttccagtagcagagagacctttagcacttgatttcgggccttagcgggccagtttgtgaggttgatttatcggagccccgccgggtttggcttgcgtagcctccaggtcttctctttatgaccatatcaaggatgccagtatgatgacccaccttgctcgttctttaggataaggtccggtgaggcgatgccagggatgtagttattggtgatgatgtgttaagaggatacggtcagatttgtgtgcctaatgtagatgggcttctggagttgattctataggaggcccacagctcgcgttccatccatcgggtgccatgaagatgtatcaagatctgagacagcattattggtggaggcggatgaaaaaagatattgttggatttgtagctggtgcttcaactgtcagcaggtcaagtatgagcaccagagaccaggtggattgcatcagaggttggatattccagagtggaactgggagcggatcaccatgactttgtaattgggcccacggtcttcaagaaagttctattctatttgtgttattgtggatcggctgaccaagtctgcgcacttcattcttgttggtactactatccttcggagaggttggctgggatttatatccgggagattttcggttgcatggtgttccagtttccatcatttctgatagaggtactcagtatacattgtagttttggagggtcttgcaagagaattggtacccaggtttagttgagcacaacttttcatcctcaaacggaccggtagtccgagcacactattcagatattaaaggtacatgttgcgcgctgtgttattgttttgggtttcatgggatcagtttctgccactcacggagtttgcatataataatagctatcagtcgagtattcagatggatccgtatgaggctttatacgggaggaggtgtagatctccggtcggttggtttgagccaggtgaagctagactcttgggcacggatttggtataggatactttggataaggtgaagttaataggagcggcttagcacgcacagtctaggcagaagatctatgcggaccgaaggtccggatgtatctttcatggctagggagaaggttttgcgaaggtgtcgcctatgaagggtgttatgcggttcgggaagaggggcaagtaattccccggtccattgggctttttgaggtgcttcagagggttggagaggtggcttatagacttgccttgccacctagcttgtcaagtgtgcatccggtattccatgtttccatgcttcggaagtatattggtgacccttctcatgttttggacttcaacacggttcagctagagggttatatgtcttatgaggtagagccactagctattttgagtcgtcaggtcagaaggttaaggtttaaggatatagcttcagttaaggtgcagtgaagagggcagtcggtggaggaggccacctgggagatcgagcgggagatacagagcagatatcgtcacttatttgagactccaggtatgtttctagacccgttcgaggacgaacgtttgtttaagacgggtagaatggaaccacccggccggtcgttccgagagtttagcccagtttcccctatttctgctttatcatgtgttatttggcttatttatgttgtgttgggtcggttggctcgggttcagagtggttgtggagagaaatgagatacttagtctttttaattggtgaattaattggataagtcaaccggaagttgacttatgggtgaacggtctcggaatgtggtttatgatctggatagcttcgttagatgatttgggacttaggagtgtgttcggaatgttattcggggcccgtaatataattagactagaattggagaacttggatttttggtgacttccggttggcagtgaaaaattagctatcggggtcggaatggaattctgaaagttggagcaggtccgtagtgtcatttgtgatgtgtgtgcaaaatttcaggtcattcggaggtgatttggtaggtttcgacgttgtttgtggaatttgaaatttctaagttcttaggcttgaatccgaggttgatttggtgtttcggtattgttttgagtggttcggaagctctactaagtttgaatgaggctatgggatgtgttggcatgtttggttgaggttctgagggcctcgggtgtgtttacggtggttaatggaccaattcttggacttagaaagtggcagattttgctggtgtgagccttcaggtttccttatacgcaatcccgtgggtatgtttgcgatcgcgtaggcttaattggggaggaggtggaatttgttctatgcgatcgcttagaggggtcgcgatcacgtgagtgcgtgaagtggtgtttctagaacgtgtggcagtgtcgcgtttgcgtagtgtattggagctgaggagagcaaaggcgattgtgctttgcgatcacgtgtgtgaggttgcgatcgcgttggtctaagaggtagaggttcgcgatcgcgtagagtaaaaattcggggcagtgttatttgtgcttcacgatcacgtgggaattttcgtgatcgcaatgaagaaaatacctgggcaaaatgttttaagctcaaaaacgaggttttagctcataacaccaaaattcattagagagctcgggagaaggagaatttggaggggattttcagtagagcgattggggtaaatgttcttcactcatatttggtttaatttcatgattatgtcttgaattttatcatttaatttggaaatttggagtgaatgttgggagaaaatggaagaaaattggagaaatttttttggggatttgaatggccatttgaagtcggatttcgatgaattttaaataggtagactcgtgagtgaataaggattctagttttattatttttatcgaattccgagatatgggcccggggccgggtttggccaatttttgagatttttattaaatttgataattttcgcgtgggttttgttcctttatcatatattgatgatacgttactgattttggttagattctgaataattggaggctgagtcaagaggcaaaggcatcgcggattaggattttggccggtttgaggtaagtaattattgtaaatctcgtcttgagggtatgaaaccccagactttgcattatatcactattttggagtagcgcacatgctagatgacgattgtgtgtggcgtacactattgaaggattgtgacttggtccgtcccgtagcaactaataagttgcgcatttgattacaaatcatatgatattttatgtttaaggattattactgtgttttgggatgaatgccgtatttgggactcgtgccaagtttttggacccttaggggctttaaactgctattcctcactgttttgacttaataattacactcagtcatactatgtctatcttattttgaaactcagtctcatttacactatttgatgcataaaatgatattttggatggagtaccccgttttactgatagcctgagtggcttgagaggtttttgactgagtgaggccaagggcttatgtggtgaggatattatgggatcgggatgcgcgccgcagcatgttactctgtttatgatatatgagagaccgagagcctgagtgattatgcacgagatggcttgttataatgcttgggctataggagcccctccggagtctgtacacccccatttagcacaagtacctacttagtgcgagtaacgagtgattgggaggcatgagtgactgtgaggtatgcccgaggggctgattccaagtgattgtgaggtatgctgagcgactaattctgagtgagttatgcccaagggactgattctgagtgatatttgttgaaatcggcttttaagcgttatgaattgtcgtatctacgatttcgaaagaagaattgtatctgctgcggattgataacatgttttatgtgtttcatatttctcagactttatttactttcattactactgagtttggcgtactcacattactccctgcaccttgtgtgcagatccaggtgctagggcggagtgactgtttacttgttccagggatttctcggagatttgcgaggtagctgcacgcgtccgcaaccctgccttctcattcttactattatagagtttattttctagacttgtatattttctttagatgctcatgaccagtgactctgggatttttggttgtatctattattcggcatatcttagtctgtttaaaaatgcttaaatgaaaccttttataaattatcggtttagaatgatataatcggaaggttctttatattttgagtattgaattggctggtctagtatcgcgataggcgccatcacggccgggatagttttggggtcgtgacacgccatttgccacatcaacagtgagtgtattgcacacactttgtaagtttcactaattgtcaaaagaatgtctaattggaacacagttcgtgaaatgtacgtactcattaagaacacccctaagtttggtgtctaaatgaaaaatcgtgcaagctttaagtgtctcaatatgtattaacgcctttagttaaacgcttatagaagaagctaaaatatgtgcttttggaattgctttcgacataaaagttatttacgtttaaagaatattttgtttattcccaagtcaaatcgttatacctcagctaaaacttaatgtgctttgacagattatatgattttttctctttattatttttacttattgatgataggctataattacgtattttgtcacttattacaatctaatttactgcactttaattgagtttgagctttaatctctagtgttttgcactaattctgtattttatgccttgtaggagtgattccgagctatgtagatattatgaaatgaattcaagtggcttggagctttgaagtctgagtaaaagcccaagaaattaagtcgggatcgtgctcggggatcaacagatgatagttaataacgaaagaagaatcgagtaggcatattgcgcactatctagtaaaatgcacataaccttttgctcagaagttcattcggctccacaatatatggttggaaagctaactcaaagggctacaacttttatgttttatatttttccaaattgctaacgaaacagggttaaaagtgcgcggtaagtgcgccactgcgcactgaccgtgcaaatagggcagaaagtgtgaaatgtgtgccaagtgcgccggcaccctttcaggtgcgcggccgacacgtcatgtcatggaaaatgtcctattgtgcgtaggagaatgcataattatttgggcccgaccctacttggtatatatacatggaaaaatgatattttgaagactttggacataatttagacctaaggaggaggaggagacactactttaggtttagacaacacccttggaggcaagaacagctaggagcaaggaggaagattcaaccacgagcttttccccttcttcttcctatttttattgttggttatgaactggagtattgtgttttcacatacttttatgaatagttaatttattatctagagtttttggtggaacctcttggaggatgaattcttgttatattttaaataatttaacctttggatttatctacttgttcaactacgtgcttatttcagttggttgaatggccatcgattgactgtatctatttagtatgtgttgtttgagaaagaatatatatttaggtggtcgttgaacaacgtcactcctaaggtatatgagagatcaatacggcaggtttaaaagggggattagagataacgaagctttgaagtgatcatagtgagcgctgaaaaagtgtgagctagcacaatttgagagaatatgattagtacattattgtagttgctcgagagagaattacagttagtagagtgctcatgatcagtagagaatagttaggcaaaattatagaagacgtagcaggaaggactccgataattggggaaatcataactctagacctccttaatttagtctccagcccttagttttcttagttgatacatttcattgctttttgataattattagttaattagtttaggtaacttaaagttattcgagcttatcctcttggtgatattgaacaattatggtgaaaccttagttctctatgggattcgactccgaacttgtagaccggattatatttgcagcgaccgcttatcctttttaggactagagttgggcgtacaaattttggccgttgccggggaactaacggtgtagttgtagttgtattatattgctaggtttaatttgaacttttattttttttttttttgtatttttttttattataactgttgatttgagaaacatgacatcttggaattatggaatttaggtgtagataattctactattgatcctcataatatatgtgaaggaaaccacccgtatcaaaattatcaaaatattccgaggagttatgtgaccaactcaatcttatttgtggaatgtgtgatgtgtgtggtggtaaaaatggtcacttttatggttgtgcttatatttcttatcttcccccaaccccttactatgatggttctaccttttcttgtgaagttaacaggaacaaaactggggatcagacctgaaggagatcaaggatatgttaaagtgcttctggaacaaaataatgaaaaacaattgcagatagaaaggcaagaggcaactattcgcaacttggaggctcaagtgagtcaagtggttgaagcttttaatgctcagcaagccaattttgggatagagccaagaagagcgtgaatttgaggtgctaattgaggaggtcagagtagaacatcaacaacctagccaactacaatttgaggatgtcgatgttgaagaagtgagactagagtcagccaaggacattgaggataataattttgttcactctagtatcattgatgttgagtaatagaaagtcctgaagttcatgtgtttgtgtgcattgggcccctccaaacatttttccacattgtgcttggatgatgatatgaaaataaagtcatccaagccgattgaggagtcaaggaatgaggaacatggtgcctacattctagaatttttctttctagaaagataggactatatacctcatctaaaaaccaagaactgtataatagtacaaggccaattagatttgttccaccacccctggagcataatcgaaaacttgaagtaaaattggtggttcaatttataagctcgtggtggaggcaaaaagtgatcagcgtcgtgccgtgacgttaaatcaagagctttttgggaggcaacccagctttactgctttcttttattttttattattgtttataattgtattatttttatagtgtcaatttttgattttctaggagaatggaaagcaaagctattggaaggatgcaacagcaaaccagatggttggggctaagtgtgaggtactcacacgaaggaccagacctgggagaagtttgagtaccacatgagctgctagtgcatcggcctttggcataccagggagtttcttttacctcttattagttatgatgtgcataggggacaatgcacaattttaagtgggaagtgaggagattgtctggtgactttctatgctactttagttgtgttagttaaattgaataatgccattttttttaaaaaaatggacttttcccgacggtggatctattagacaattttcttgaggcatttaagtcgaaaggaaaaagacaaaaagattttcttttgttaggtagtgtagcaattgccccttggtttttttttgtgccgcggttcttattcaaggattttgtttgaaccagatgttgctacttttttattttcttaggaattctatgttactttagcggtgctagttaaattgaataatgcctttttctaaaaaaagaattggacttttcccgatgatggatctattagacaattttcttgagggatttaagtcgaaagaaaaagacaaaaagattttcttttgttaggtagtgtagcaattacccttagtttttctttgtgctacggttcttttccaagggttttgtttgaacagggtgtagctagttttatttctcttaggaataggagccattgtgctgtattttgaattgaagcaatatctcttaactttgttatgcttgagaatagtgagtactttggttgtgacgcttaggctcagtgttttactcttgtagaagtaccttaaattatatgatatttactttgcttaaatgctttgactagagtgtcttgatgaatccaatcttgggtgagtcatgtgccatgtgtgtgtgaggtttgggtgttattctgtgcattgcatttgatgcctagaacttgccacgtgtgtttgcaaagcgaaatagtagttttattcagtcttggaagtgatataggcgattctttgttgagctagatacgtatattttacccgcttaattgttatgtatcgtacctttgagcctataaccttgtttcattggcaaccacattacaagccttacccatttgtttgaattaaccatctatttgaaccttttaacctctcatgagcacttgaatagttatgatctttgaagttaaagtgtgggttggttggtttggattttgagtggaactaataaaataaggagaaaggtgcactgttttgaaaaagtaagagccacttgaattgaaaaataaagaaaaggaaaaaatagttgtatttctgtgaaaaaaaatatgtcttgatcagtgatgactcttgatataattgtgcttaaagaagtatggggtaatatacattaatgtgaaggtaaagtttggtttgacataagtatggggtttaaatgttaaagtatatgtattaaagtgctcagggaggtgtaatcactcttatatctaaatgtatcctacccgtcccgcattacaaccaaataaagtcctacttgatcctagactgaatgagctcgattagcagagtaggacactacaggcaagcctatggtgcatcttttgtggcatatgaatgttgtttctgagagtgagtgagttctttctatcttgagttcctaagtgttcttagattttattgtgtggaactactctctttagttgtgtgagggcacttgattcatgaaggaaaggtaatgttagtgacctttatatttgagtaagtgagtgagttgttaataatatgtagtacttgtaagtcaaatcttgaggtgaaaatgttacgcttttgtgcttagtctattttaagcattcttggtgtgacgagttagaagaattgtttaaaaaggtcgtatctatataaagtgtagtttgattgcttgaggaagagcaatggtttaagtgtggggtgtttatgataggctataattacgtattttagtcgcttattacactctaatttactgcagtttaattgagtttgagctttaatcgctagtgttttgcactaattgtgtgtttccttataagagtgattacgagctatatagatgttatgtagtgaattcaagtgatttggagctttggattcaaagtaaaagcccaaggaattaagccaggatcgtattcggggatcaaaggatgatagttaagaacgaacaaagaattgagtaggcatattgcgtattgtctagtaaaatgcacataaccttctgttcagagctccatttggtctccataatatatggttggaaatataattcaaagggatacaacttttatgttttacgtttttccaaatttccaacgtaacagggtgaaaaatatgcggcaagttcgaggcctcgcacgaaccgcgcaaaaggggcaaaaagtgtgaaatgtgcgggggcacctttccaggtgcgcggccggcgcacgtcatgtcagggaaaatgtcatttttcgcgtattagaatgtataattatttgagccctaccctacttggtatatatacatggaaaaacgttattttgaggactttggacataatttagacctaaggaggaggagacactactttaaggttagacaacacccttggaggcaagaacacgctaggagcaagaaggatgattcaaccacgagttttttcccttcttcttcctatttttattgttggttatgaattggagtattgtgttttcacatacttttatgaatagttaatttattatctagagttttgagaacctcttggaggatgaattcttgttatgttttaatattatttaacctttgaatttatctacttgttcaattacgtgcttatttcagttggttgaatggccattgattgactgtgcttagtatgtgttggttgagaaaggatatatatttaggtggttgttgaacaacaccactcctaaggtatatgagagatcaatacggcagatttaaaagcgggattagagataacgaagttttgacgtgatcatagtgagcggtgaaaaagtgcgagctagcacaattcgagagaatatgactagtacattattgtagttgctcgagagagaattacaataagtgttcatgatcagtagagaataataattagacgaaattatagaagatatagcaggaaggactccgataattgaggaaatcataattctagacctccttaatttagtctccaacccttagtttctttagttgataaacttctattgctttttgataattattagttaattagtttaggtaaattaaaagttattcgagcttatcctcttggtgatattgaacagttacagtgaaaccttagttctttgtgggattcaactccggacttttagagcccgtttggatgagcttgttttaagtgactttttagccaaaatagcttttaagccataagttaagaattctaacttttggctttcggcttgtttttgttattttagcttaaaaacaagtacttaaaagcactttgttactttattcaaacactacaaagtggcttaaaagctattttttgcttaaaagtgcttaaaataagccaatccaaacgggctcttagatcggattatatttgcagcagcgaccgcttatcatttctaggacctgagttggacatgatcacttacctcaagaacattcctatgatttgccataatatactatttttaactctaaataattaaaattgattgatgatggtattaacatcgcccaagaaatgcaaccttttgtataaatggtgatggtttttctttccacataaagggactacttctatggcactgatattttttttcttcttttctacttatattatagttgcaatatttttctttcttaaattttatttaaagaggacgggtaaggcaagtttggagtgactcactgagaggttacatgttatctttagaacatctgaaatgctcgaagaatagaggtagagtacgaagattctgttatacaagaacaatgatgatatctcaaaattgtaacaactatagaggtattaagttgctaagccatattatgaaagtttgggagaggatggtagatacgagggtgatcatccaccattgaagccattcatcttataaggaggttggtagaacggtataggaaaatgaagagcgacttgcatatggtgtccattgatctggaagaggcgtacgataaagtccaaaggaagttctatggaggagttggaggtgttcttgtagcttacattaggacgcttaagaatacgtatgatagagctaagatcggggtaagggcagtgggaggagacgagacacttttcagtcatgatggggttgcaccgggattcagctcttagcccgttcttatttgccttggtgatgggtataccggcgtggcacattcaaggggaggttcggatcatgttatttccagatgaccggttgatgaaatgcgaggcagagttaatgttaggctggagatatggagacagacaccggaacttaaggtttcaagatgagcatgactaaaacctaataaatggagtgcaagttcagtgtcgtaactcatgaagctgaaatgagagtgaggcttgatacacaagtcatcccaagagggggagtttcaagtatcttgggtcaataatccaagataaaggggagattaacgaggatatcacacacaatattggagcatagtggatgaaatagaatcttgtttctggtgcttgtgttataagaatgtgttagcaagacttaaaggtaaattctatgaagtggtggttagactgactatgttgtatggggtggagttggccgatcaagaacatatccagaagatgaaagtaacgaagatgatgatgttgagatggatgtttgagcatttcctagaatatatagggtcaggaatgaagatattcggcactaggggcgtctcagtgaaggataagatacgtgaagtgagactgaaatgattcatacatgtgatgaggaggtggtcatatcctgtgaggaagtgtgagagattcaatatggtgggcctgcagaaaggtagagtaagaccaaagacgtattagggagaggtattaggcaggtcaagacgcttcttcagctaactaagaacatgattattgataggaggttgtgaatgtcgaagattagggtagaagattactagtaatagtgtgttcttcctttctagctttagcattattcttgttttgttcttatgcttggatatctactattacctgatgttgtttctccaaaaataacatctctacttgcacaagaagtaacaataaagttgatgtatacactaccagccttagactccctttgtcaaaatacattaggtatgtcgttttactgccattacagtcggaatacactaggtatgtcgttttaatgccattacaatatcatctacaggatgattgaaattaaaaggaatttcaattttgcagtacctggcaactgacgagatgtattaacaagctaagaaccttgatattacgtttacttgattctctatatgcaattattaactaatcgaaatgtcaacttttaacattatgtgatctctggtacttctacgtgacaactctaataaaatttagaccctcatctcctataattctacccagtatactaacggctcgccatgaattagttgcattacacacattaatattaaagattttgttctgtcctctagacgtttattatgttgtcactattgcttgtaaatttgaattgtaaactagactgatgtaagaaaagatactggatatactaatcttgtttcacattgcaatttctctgaggaacaaatccatctacgagtttatccaaccctttgcacagaattattgcccttttttggtcatttgtctattacgaagaagaatatttgagactattacaaacaaagctcaccgtacaaggttttgaacgtcccaacaagacaaaaagttcagtttcttttccaacgccttagattcttccaatctccaccaatatgtagccaatgatatcttggttcgtcctattgatttgtcctgtcaaatacagaggaggaaaaagaaagggttacataatagaacttaagactgcaacgtcattgagttggcaacaagaaaaaacatggacataaaacgaacatttacctctctcgtaacacaacatagcttgttcctgtaccggtcttctgtatcttggagatcttcctcaatacatcagcaaaagcagccttatcctgcaccaatataattaatgcggtcatgcaagggagggaggaacctacaatatcacaagtaaaaggagttccggaacttggctgacatgcagctatgctgaggacatctagttgtgctttacatttttgggatgcttatacacaccaaaaaaaaaagactaaatatgaagaggattagatgcatcagctataggtcagtgagacacaatggacaaatctatctcgaaaacaagccttgtcataccctttcattttaaacgagatttaaattggctgacaagatcctgtgtggtcactggttttctctgcaatagaacagctctaatttcttcttcagtaacaggacctgtggcaggacttggagcagttttggaagagggtgatgcaccctttgggagaacactgttcttcgcagtagacggagtttcatctttcccaggtttggcatcctgcacgatatgaagggaaggagatcagcaagagaaaggaaataattcctccttagaaaatcaagaagttggttatggacatgctagccttaacatcatagttctgataaaacagcaactgcaaatcaactttccgacttagcgtttcttccttctcctaaattctttagactaaaaggaccacaagtggttttccaggtgattatgaaactcatgccttgccagcataatattcccatgcaaaggacatatcacgccaaaagcaaataaatattatagttagtaatttcgtaccgtttctgtttcacttttttcaagggagcaccattggttggttttgagtcatcaacattagcttttcttttagtcttagctgattttgaagttggagttccacgagtgggtccagaagcagatggtttcgaaggactgctgttgtcgatcggttcttctttgggagcttccttcggcttaggagctaatacaggtgaaatatcctcttctgtctgatgaagacagaacaagagaagacaattcagacggattttaaaaccatggaatggaaaaacataattactcctgtcaaaactaacaaatggagaaaaccgccaactcagatcattccaaccaggataaggaaaatagcgcataaaaagtaaaagagacattcacttagcaaccaataatgaatcaaaacttacatcatcgtcatcatcgtcatcatcagcatctgattcattcaatccattagcttttccaagcaactttttcagctctttaccagatttactcagacccctccctcttcatcaccttcatcctcgtcttcgtcatcctaaccacacggagaagggacaaaagttattatatagagcttcacagctgcagagaagaacgttaaaacacaaaatacaaagacactttctcgatccatggtcctactaaatcccgtcccagttagtagtacttactatttacatatacgatatcatttaaacatagaagtggagctccttctgacaacaaaatgatattcccccaaagtttatggaactaagaacaagtacactggtccattttcaagatcattcttagtattcagaaaaggaaattgtatcacaacagatatacatttacttacactttaatcagtgctgggcaaggctccctacatcctattggcaacaaaaccacactcaaggccagaaaaaattatagactatttttttactgtatgatcttaatggtcaggaagccaattctcaactctgttgctttgtcaatatctgattcatttgatgagggtagttaacttgaatgtcacatcataaaactgacaagaaaaaagttacattgcacatttagagcaacaggaaaattcctacaatattttctaattatagtaatccttcaagtaatgcttttgtaggatgtcaaagttttttaataaggtaaaaagttttgtaatctgagggagtccagtcccagtagccagaaaagagtctaaacaccaaacttattttacggcagagcaaacaaaaatacggcaaatatatggcactggcttttgtataagatagttatccaataacttccatacctcaaatacatgtcacatagtcctgcagggtgcagcgtgatgtaaagttatttactatcagaatttgcaaatcccacacataactaacctgcttaatctcggaggagcaggaatttcaggagccaaatcttccctctcctcaggatcattcccaacagcttcatcatcatccgtaaaaatctcttcatgctcccaatcatcccctgaaagaaatgagagaccttcagcagaaacaaaagaaatctgaaaacaaaagctgatcaaatagtcaagaacaatctaatgcacaagctaatctgcacccctagcctcaggaaaaagaaaaacagaaccacagatgaactatgtcccactctagagtgaaacaataataacagtcattagtcagttagaagccatttcctattctcgaaagtaggacaggataaaagatatttgtgaactgcgtaattcgtggacacttaatttacaagaaaaagaggcaaacatataaaatgatgatttcaaagagaaaataccaggagaaccctatcatactagctgatagctagacggaggaatgatattgggctttccaacacaaccattaataatgaaaatgcagacatagatcactaaatagttaaatcaatgggcagcaatctcgaatgtgcaatgcaaggcattctaggaagaagaaagactgacctttttcaatatcatcatcatccaggtcaagatcacccctctaggaccctcttcatcatcatcagcgcctcttttgttgagtcccaacctgctttttctagcagcctcctcttcctcatcttcatccccatggtccgaaccgttgccttcctcctcatcaccagaagttttcttacgcccccttgtcccaccagatccactttccttgtcatcaatctttctacttcaccgaaggcagcaggtccattatttgctgctttcatcatccatctctggtacccatctgcagttttccttctatttttcattttctcctctgcttcctccagagtaagttgcttatattgggcaactttgttaaagttgtacctaatgatttcaacggaaaaaatgaatagatgcagatccagaatctaaacgaagctgcagaatacttttggcgtcaatgctacagaaacaacaaaaactaagatgcgtaccaagaaccagctggaatagcaaccaactcttcaccctgcatcatcaatagataatattgtgcagactgtgctccctcaagctgaccatggaactgaaattgaccggtttcatcctctaatagccatggtttattcttgtacttttcctgcaatcatagaaaataaaggtcgtaaatgaactcataacattcgataggagaaaaaagagcactgccaccaaagatcataatttgataagagtagaacaggcacccatagtagcatatctatgatccaagacgcggagcatgtggtctctattagttattacattgttcatcaaaaaaagataccttttgataaatataattaagaaccttctatctaattatatttctcacacttctgcataagaggctcaacggaatagggcgaagtactccctcagcatcaagcagggtggagcttagtcaaatgaagtggtgaaccgccaactgtgccaaaaacgtggagaatactaccaagtgaattagtcaacatccaagtgatccatagtgcagtgtttcaaagaaaccaaccatctagctccagggatttggttcaatagtaaaaatagtacagcacaaaatgcatataggcaaatgtcgagagttcgaattctaactggtgaactgagtctggcatttgagtggagaagggtagaggggtgggttgattatccatcaagttttggaggattctcgtgattaaaaaaagaaaccaaacatttatggtgttgaagaagaaattgagtcaagcgagacaccaactcgaaaatcaaggaaagtccactctaacaagtcgcaaatcaatggtaagaattcaatgcaactaacagttgtttctcatgtattttctatagctagctcaaaagtccagtactatatttcacccatagacattagaagttgcttcgagttgcctgctagggtgcacatttggtcagtccatcaatctaggtaaattcagtatgctgcttggactctccgaaaatgttgattggtgcatgtaagatcctccaaaagtagtgcatttttggaggatccatcaggggtgcggcagctgtccgtgcagcatagaattcagttagcttcattcatcgttgatttgtatgtatgcgtaaccatcactaaatcgatacagatcggtttctttttactctcttttggttcgactttttgcctagacttcaaattgatgcttcaaaaacacatttttctttcctaaagttgtacaaattaattaagtccttgagaatattgattcttcacagaagacatccatcaagaatattattaatgttcaacctatggtcaacttgttattcatgcagtcaatctaagcagtttatattccatatggtcaatctgaatagtttattccagatctcacttcatggtcatttatgtaccagtaaatttacaggttttcgtggcattaagcgtagttacacttctcttcctaacctgaaatccaactaatcactcaaggttcattgtcttgatacaaattattatacttgagaaacacatataaaatatgtatttttttttgtgtgtgtgtatttgtatactgatgcaacgaggatgatactgttaaatatttcatacccgcaaagtatccgtaacttgacgtccttgcaaaccttctttttgtaaagtccatttactctcattcttcttttttgaaaagttcggtaagcctgaagcaaatcgagcaatgaaataattcttgtcattgctggagcaagcccgaacattatactcctgcacataaacatggtttcggtaaccagttttatacccattttgcaccattggtaaagtaaaaaatgcatcacatacaaattctttcatgaattgacacaattgaatgctttgacaaaaattcagtccacaatagctaccaaaagtgtggtctgaccaaaggtctaattgatatcattagcacgattaagacgttcacataatattttggacaaaatagagcaaatcaaaccattcagcatcagaaagataaaaacttctattgagcaggcacagcaagcacatcctaacttaaggctgtttgacacacttcacctcttatatctgctaattgcctgagccttcacacagttaatatcagtcatgctcgtgaaataattgcttttgtgcaattaaacctcaatttcatcaatagtaataaagacagaacaattctaagtgaatacatgaactgttacacaaaaattacagaaaatcatagcagatcagacaaaacacctacctaatccaaaatgaaagaatcagaagtagaccccttcattcaactttccaacacatcaattgagaaactagtgccataacagaaaaagctcatctggtatttctgttcagaactcttgaacataaggtccgcttttacttaaccaaaaacattctgcagggtgagcatagaatattttggagaagtagaaaggtctaatatttgcttctcaaacacatgctacagatcaatacatgtaccttaatgaagcaagctttaccactaggttatacaatagtgcctatattcctcatttttctctaatactatccttgttcaggtctcagataatcttaacaaaagtaagaaggaactagttcacggcttcacgcattaaatcaatataagctcaagactaaattgttgatattggcgtggcaaatagttatgtttagaaaatgaaaacgtaaccaggaaaacaaggataaaaaaatataactaaaaggctagagaacaaaggatgaatataaaaaagtagtgaagaaagtatatgggtggcagaagctcttgatcttggtggaagaaaggaggaaaagataatgttcttgggttaaataaagataaaggggaggatagtatacggatgtagcctacctatatgtatcaacatcttctatcaaccatcgcttacttcattgtctaaaggaaaacaaaacgtgaatcggtctttattcaacaacagatgaagctttatttttatcaattgaatcctacggaataaaaaagtgagtcaatccatttggattaatgatcaccattaataaccgaatctccaaatatttacacgtaactccacatcgttgagtgacaaagtaatccaatgttctcggagaaggcctaaaagttggttgcgactgccatacaattttatttatcatttagaagcaaaggcagatcagattgggtgactatatccacgaagttctgaatctctcaattacgtcaatgaaacctctagaatctacttgctgtaattgcactcccaaatcagcaccatcaaactcaaacacactgatatctttgcagaagtgaaacctagcctatgtctacctaaccaattgcctcaaaagaacaaaggacataaggcttagagcccaggaaaaaaaaaccaaattctccacaaactcaaagaaactactagcatctatcaactatgcctcccaaactagttgggatccataatatgaatactcaccagcaacctacctacaccatgcctttgctccaaacaaatagactattattctatgaggagcactaaccacaattgagacattgatcaatcacacctaagtactaaaattatatgtaatagatcccagcggagacaaaaacactaggtgattcttccatccgccgaagcctggtgagtgagttaacaggtactgttattttggtaggagtgtcaggtacccaatgaatagtcgaggtatgcgcaaaacaaaatttataaatagacacatgttatgcagtatttatttggagcaagaccggtgtaactcttcctaaatccttgatacactctctctacggactcattccattcccatacttaagaaattacacacaaaagccccagggctatgtccagtggtaagagcactatgcataatgcgtgtgttagcttcacatcatgatttcgagccaaccgaagacaaaagcctagtattaagttcgaaatgtagagctgctggctccggagatatctccattatcaaacaaaagtaattacacatatagaaattccccaaattctagtactcatgacaagttcatacaggaaacatactcgaatcagtcgttgtgatcggagcgccacactcataacatttatcacgagtctcagccatgttttaccacaagacatgcaaagagtcaagtgcttgcaggtgcttccgtacaactccgacgtggagccgcacctgctacacgacggtttcagtaccaaatctatcgacattatagcgccttaattctcttctcctgcaatcaaaaacaaaaatcaagccatttagttcatcagaattagggttccgtttaaccgattcaattttgggcaaattgactagataatcaaatatccgttaatcttattgtgtattgattcagtatttgcaatttttgaatttttcttttgagttacgattttaaggaattttttagatctacagcaccgaagcgggcatgaaatggaataaactgatgagtaaggcgggtatttatagatggaaccacgcctagttttctggttctgttttaataaccacctcaagtttgggaaattgctgtttagacccgttagattttcttttctgaacttgaatttctcatttaagatctcgtatcaattaagaaatctattttttaacattaactagtatacgtattcgtgcgatgcgcgaatcaattaaaatgaaaaaaggagcggaaagagataatagaaacatatgtatattacatattattttagcgatcgaattaaaaggaattaaaacaaaaataaataaattaatttcgtggggctaatattaagtatgataaaagacagtctgagggctgaggcactaaccttgcaataatataggaagatgatgtattctcatgtctgcacaatgagttacatgtgcatcattattgttataattattatcaacttaaccatatattctaataaagaataaatcatggtaaagtaaattctaatgacacaattacaaatataataaatcgatgcagtgttaccactatttgttacatcgacaaaggaggaactgtttcttcacgttcgacttaataattctgcttttggaagattcaactttatctgtagaagagattcgtacattatttttaagtcagattttaaagtaacatatattataaaggaaagttactataatctatgtatggattttcccattaaagcaggaagttaaatcaaagtgcataagaaagcaaaataaaattaaaaaaaatagtaaaatagcaacaagcgacacaaaaacaaaaaaaaaaaattttgatatttgaaatgaaaattaatacataccattcatctttcggtgataacattcaaagattaatcaattaaaaagattaatctggaaatgttttaaagttcaaagttattgtaaaatataatttgataagtattcagaaatatgtaaaaaaaaaaaatcgtccacctgaaaattatgttgctccttagctatttagcatgtcttattttgcagtaattttatttttcagtagcctactatgaagctggtctttcaatgtgtaaaaccaaatcacattttcagaatcaagtccttttataagtttagttcatatattgacctcgaaaatacctttgatgaaattatttaatatttataagtaatacatattggataatataagtcaaggaaaaagtgtatatgaaaaaagtcttaaataaagaatataactgaggtacattttttacaatataggtattgtgtttaaatcaaagagaaaaatgatgtatcatcatgtctacacaatgagttgttgatggatcccctcgcgggactgagctaccttgtgagctaacctcaactcctactgctgcggaaatcataccatcctattaccttactataagaaattatatcggcaggcttgtcccgatttcattggctaaagactgctttcaagtaggttgaactctgactcttgttccccaggaccagggtctgtaatgcttactgtccttaccaagacctactctctaatcagtcgagcttcaagaccttctccttaaccggtatacttaagtcgttaatcttcgtctggagctatagctctccccgcaattccaagtcggctatgcatcattagttgtataagtattaatcaactaaatcaaatatttttgttgagaagagcaaaccgatttctgaccaagcacttttagtttgcactgccagaacataaaagtatttacgccatttaaccaaagaaaactcaatacactttaataaattaaagtttaaaaaattagaattgttggacttaagcattgggctttaaagactaagagtgtgaattgggaaattgtgggaaataaaatggagggaaatgaaaatttgaatcaagtgagcttttgtcatgaatttgtaccatatcggtgaaagacaactacactttgtgtgtataaatataagatcacttcttagagctcttaaaaggagttgaagagaatgaaccctcgcgtcgtcgtcgtcgctcggcttcggctttggatttgtcaaagatcgataagattaatttttggacaaaatttatttaattaattatttaataattaattaaatgccagtaactggaatccaaaaaaaatgttgaacgttgctttcctttgaacagacacttcttcctgaaccgacatcacacctcttccgataattgcctataaattctgaggcatgacttccttttcacttactgaaaatcaaggaatttcttctgaatactgcattcttcttcgcagtctctctcctctctctctcaaattcgtaagtgtgattttgctccgttctttgagttcgttgatatcctgcagtttgtattgccactgttgcaggaaggttttttccttttcatcctgggaggatttaatccattaccttggcaacttgtgaggggtttaaaattccttaaggacgcacaaggaaattgtggactcggaatatttcttatcgtttttccagattttctgtttcttctaacagttttctgatttctattttaacacaatatcgtttacaaaaattattaaagacacgcagagtcatagcaggaaccatttaagtgatttttccttttctcccttacttctatctatatataaaagcaaaaaaaatttaattaaaaagttaaattatattaatgccattctaaacactctgcatcttatattagtcaaatttgataaaccattgaaatgcaaaggtaactcaatttagaatagcagagatatagcaataatttgtgaatcttttttttttttttgtagctctttactcattgcttgtatacattttattttttttctgtcctcagaagagaatttctgaaagttgattcaggatcatattgagtactttagccttaaattatgtgaggtgtaaacaattccatactctgcattactgagttatagatattacatagagtacagagaaaatagtgggcgactaattaaaataaaatgagaataacatgaatcacgtgtttttccacaactataaacgagatagcagaggttaaccatagaatcacgtgattttccacaactataatattccataaaagatagtcttatgcttgctactaattgggaattgtgtttaaattaaaaattacacaagctaatcaggttgtggctgcgtcaacgataaataacaacgacgacgacttagtagaaataaaagctccaagagaatgtgaaaaacagctagtgctcagacccagtacctaaatctacacacaaggtgcaggaagtaatgtaagtacgtcaactcagtagtaatgagagtaaataatgcctaaggctatgaaacaagtaaaaaaatagtcatcaatgcacaatacatgaaacctttctttcagaaaacacagatacgatatctggtaatatttgtaaatcgctttcagtaatttatcctttaaaaatgtacccttatttttcaatttccatagaaatcaaaatggcttagtatatgaaaagacagagttcagactttcagatgaaacatgtatcataaatagccctcgggcgtatcatcactcacatgcctcacaatcgctcggtatcagccctcaggctacctcatagtcactcatgcctcccgatctctcatcattcggcactcgcactcagtaagtacctccactcactgggggcgtacagactccggaggggctcctacagcccaagcactaatatcaagccatctcgtggcataatcatcaggctctcagcctctctcatatcaggaatagtgtaatatgttgtggcgtgcagaccgatcccataaaatcctcacaacataggccctcagcctcattcagtcagaaacctctcaaaaatccactcgggctatcagtaaaccggggtactcgacccaaaatatcattctatacctcaaaatagagaaaataagactgagttttgaaatcagttaaacatagtatgactgagtgtaaatcataagtcaacacagtgaggaataacagtaagaaaaagcccccaagggtccaaacaggtcggcacaaggccccaaacatggcatacaacccaaaatgtagtaatagttttaaaaacatggaatatcatatgaaagagaatcaagtacgcaacttaatagttttcacgggatggaccatgtcacaatccccccagtgcgccatacactcatcatctagtatgtgtgccactccaaaaataatgataaaatatgaagttcgaggtttcataccctcaggacaatatttacagtcattacttacctcaaaccggcccaaatactaatccacgatgctcttgcctcttgaatcggcctccgatcgctccaaatctaaccaaaatcagattaatatcattaatatatgctaggtagacgaaacccattcaaaaagtatcaaaattaagcacaaatccgaaattggccaaacccgacccctgggcccacgtctcgaaatttgataaaaatcacatcacaagaatcctcacgctctcccgagtccatacatataaaatacatcaaaatccaaccacaaatgacccctcaattccaccatttaaagtctccaaatcataagccctaaacccccaatttagtcacaaaatttccataaatttcacccctaatcaatcaaataacaccatagaaatgagttttagatccaaaaatcttacctccacgaagttcccttgatttccctcttcgaaaccctctctcaagctcaaacccgtatgaaaacttggagaaataacccaaaattcgtgaaggcttctttttatacattctgcccaggaaaaacgcacctgcggtcctttttttcgcactgcagacccgcacttgcggtccaaggtgcgcacctgcggaatttcattaaaggaccaaattctgcatctgcggttgccagcccacctgcgggctcgcaagtgcggtcctctttccgcatctgcgaccaaccctcaccagaccaaaatccgcacatgcggctccccttccgcaggtgcggccccaccagcaactcagcaccagcagcagcttctgctacattttccaattttcaacctcctgatgaccctctgaaatcaccccgagcccctcgaggccctaaccaatggtacccacaagtcacaaatgatcacccagacttagtcgaaccctcggagcacccgaaataatattgaaataccaattcaactcatgattcaagccaaagaacttagaaattctaaatttcgccaatgatgttgaaaccacccaaaacacgtcgaaatgaccagaaaacttgcacacacatccaaaatgacactacaaacctgtttcaacttccggaattcaattgagaccctgatagctaattttttcactgccgaccggaaatcgccaaaaactcaatttcgtcatttcaagcctaattatacttcggacctcaaaaccatattccggacacactcctaagtcccaaatcaccttacgaagctattcgaactataaaatccatattctgaggttgtttacctaatagtcaactttcgattgacttttctaactataaggctaacctaaaagactaagtgtctcatttctcaccacgaccactccgaacccgaaccaaccgacccaacacaacataattaggttaaataacatatgataaagttgaaacaggggaaacgagactaatctctcgaagcgaccggccgggtcgttacagcacacctattcaaggtggatgtgcccaaagtatatgaggaggaggttcaaagtttctatgcagacctctttactgttgaatatgatcacgtctgcgcactggtgaatggtgttgacatggttctggattctgttttgctaggagggatactcaaagttcctgctgaaagattgtcttttgttcgaggtgcttgtggctcaaactttacgcatgctatagtcaaggagagagtagtgcagcaaggggaatgggtgtataagaaagccttgcttcctgtttatcagttgctctttgagttggtgaacaaggtcttgcttccttgttctaagaggaggtccatcaccttcaaggccgatctgtttctgatggaagctctggatgggttccaaactgttaatctatgagccataatgattgagcatatgcaaaaggtggatggaaaccatggtctctcctatggatttctccttatgcgagtcttcaaatatctcaaagtgcctttgggacagcctaaaatggggaccaataagtagactttctctaagagtacactagaggggtgtgagtgcattgacaaaagtggaggggcaggcagaacttcaatgatctcccagctcataaatgctcaaaattttactactgaagagatcagaaagttgaaggatcgaaatgccatattagagactcagttcagtcaggcccaagaggcaccagggtcttctagttattcaaacgcagaggttcctcatctgactaaggagaatgttgatctcaagcaataggttgagaacctgagggagaaactgctcgctgagaaaatgtccgccaatgctcgaatgaatctcgttcttaaaactcttgctgcctcttccaagccatcttcctctagtgtcccctaggcatattcctcagtgaccactgtcttagtttatctctcttgaaagtgttttgatgatgttgtggtggttgcttttgtttttcttttttggtttgtggatggaaatcacaagcacttctcccgtgtaaacagtccaaatatgtttttgttgtttaatgaaaactctccttctttagctgtaaatgcttttgtctttctacttctcttctctatcatatttgtgtgcacacaagtggcatgagttaactaagctagacttcttatgttatttgcttgtttgtgtgtttttgatgatgccaaaagggggaagataaattgagaattaagaatatgcagtggactgattaagggggaagcacaaagtcagggggaacttgtgcattatctggtttctgttgtattatctggtttctgttgctctgtacaggattatcaaatattaagtttgtcatcattaaaaagggggaaattgatcggtttatagtaccttagctttatattttgatgatctaataaacttgttgtcaagaaccagataaggaacctgatacacacttggtacacagctcaaacatcggactcaagctaatgagagctgctatgacttctgatagtaggatatatttgcgaaatttagacactatttacgctctaattaagatgcattttattgatatttgaatgttaaaagataacaaaatgctctaattaagaaattgatgttttgcaggagtcacttcgagttaggaggagctaaagagtgttttcgggtcattattaagcgtggaaggccaatcgaaggttagcctggtcgaaaaggagtgagaaaagcaagcgagacgacccctccaggtgcgcagccatgaagtgggccgcgaattggctcgcgaactcaaggcagggaggcagtgaaaacccgcggccgcggacgggcggacgaaagccaaacatgaagggttaattatgtaatttcctaggtgactaacctaaacctatatgaagcctaaactcgcccagaagtcagagatagctggttttagaagattctaggcaaaaacacgggagaaaagacggataatttcctaagatttcatcttcttcttcttcttacttctatttgttgattatgacttattttagtgatttattttccattagtatgagtagctaaatctattatctaggattgatggaactaattgttggatgaagtcttgactctattttgttataattgagccatgtttgttctatgattgttcaactacgtatcgtattgtggttaattgaaaggacccttgattaatcgtgtctagttaccttgtgttgcttgagaaagaatacttggttatattgttgttgaacaacaccaattttgggtaagttaagagattagttactagaatttaaaaagtggagttagaaataacgaagctttggtgggataattctgagttgcataaattgttaactagagtagttcgagagaatgcttctagtaaattatcgtaattgatcgagagataattacggtagcccggaactcataatcctcatagagtattatggcgagattatagctaaagagttaagaattaattcggcaatgggaaaatcgatagccctatatccctttatccttgaattcaattttagtcttgattattgctaattttattgtcatttttccttagctaaataaattctactgtttattcataaaaatcttgcatctggtagttgtctgagcttgtcattagcattactaaaagttgtagtaaataggttagttccctgtgggattcaactccggacttgaaccggattatatttgtagcgactgcttagtcctgttataaggcatagttgggcgtgatcaacttcaaaagataaagaatcaacacacggaactgatccccttgggttcccctggcaacagtactaaatcaactctcagagctggaaagtgactgcctgcactgtacacgcattgggaatgatcttgtaccaaccaagttattacatcattcaagtgatgtcatccaagttgtattaacattaacattacaacaaaaaatcatctgaacacttgagaattcattcaagcactccaagtatctaattatcaagcattcaattctcaagtgcatcaagaacaaagtacaacactgctacggaccagttcctacaacaagtctttgtatgtccttagttgagttgtaactttgtaattgttcttcgttgtcattcctactttgcttatcaagaagcaataattagtaaacctttgtaaaccataaactttagtgtttgtgtcgtgactagagttagtcatgtgtggaagtctttgtaataggtgtattgcaaagtggcttgtaataggtgtattaaaaggtagtgagggattaagagtttaattcctaggttacataggttgtaatctaatgatttctcatagtgaagttaaaatcctaccagtgtaggtcgtggtttttttatcccattgagcaaggatttttcaatgtaaaagttccctgtgccatttacttactgttgtgttagcttattctgtggaaactattataggacctgatttctataaagtttggtggactcatatattctatcaagtatgttccatacttggtaatagacgaagtcttttcttggtcttctgggttcatttgtatttgattgtacctagaataggcatcgagaaaggtaaggatctcgtggccgaccatggcatcgatcatacgatcgatgttaggcagtggaaaagaatctttggacatgctttgtttaagttcttatagtctacacacattctaagtttgttcccatttttagggactacaactacattagctaactattcggggtatttcacctcccggatggaccctattttgagaagtttaattacctagtcctttatgaaggcgtgctttacctcggactggggcctccacttttgctttaccggtataaattggggtgcaggctcagtcgatgcgttgttatctccaatgggatccttgtcatgtctaagtgggaccatgtaaaatagtctatgttatcaataagaaattgaataagctttttcctgagttcggaagttaaccacgttcccggtatacctttcgctcgggcaggtactcgatcagtataacctgttccagttcatcgaccgttgatttggtggcatctgaatcttcaggaacaacaaaggtttgaggggttagaaaatcctcctcttattcttcatctactacatgtttctccgattcggtcgaggctgggggcggtgattgctatttggccgcctgtttacctttggtgctcaatctttccgaggttgatagtgtcgagatcggtgttacttcatcgatcgcaaaaatttcctttgcagcatgctgttccccgtataccgtttttacaccatcggtcgtcggaactttttatttagtagagggtcgatggtactgccctcatgttatggatccaaggccttccgaatagtgcattatatctcatgtcgccctcgattatgtggaatttagtatcttgaatggttccggccacgtttaccggtaggataatctcctctttagtcgtttcactagccatattgaagccgtttaagactcgagatgtaggtacaatttggtcctgcaggccgagctgctccatgaccctcgatctaatgatgtttatcgagctacctggatccactaaaacacatttaacttgaactttatttaataagatagaaattactagagcgtcgttgtgtggctgaaaaattctatctgcttcttcgtcattgaatgataaagtgccttcgggcacataatctcgagttcgtttctctctagtgattgacaccttagtgcgtttgaatatgggtccttgtggaatgtcgacctcaccgatgatcatatgaatgacatgttgaggttcttcttgttaattcttcctattggcgtccctttccctgaaatgatttttagctcgatcgctgaggaattgtcgaaggtggcccttgttgaatagaagggctacctcctccctcaattgcctgcaatcctcggtcctatgaccgtgtgttccatgatacttgcacattaggtttgggttccttttagaaggatcggtctgtatgggtcaggccacctagtgtctttgatccttccggtagctgatactatgcctgatgcatcgacgctaaaattatattctaatagccaaggtgcctcatgggatacgcattccgggtagaattacgtcctggacagttatttctttgatccgcaacatgtggttcggtctttgttcgaccttggatccctgtcgacgtccctctgattttttcctgtcgacctatttggatgcactaaaccggaaggagctcctaattggtcgtcatcgaccctgatcttcgattgacaccgattatgtacatctgcctaagttacagctggatattcgatcaaattttgtttcaactatcgtgacgatatcaaactttgttcattcaacccttgggtgaaagcttgaacgacccaattatctgtgactggtggcaactccatgcgctccatttggaatcgggacacgaactcccttagcatctcattatcccgttgtcttaccttgaagaggtacgatttccttgttgcgacctttatggccccgacgtgtgcctttatgaaagaatccaccaacatggcgaatgaatcgatggaatttggtggcaggttgtgataccaaatcatttatcacgacccgaaattcccaccgctgggatcgtgatggtgcctaatattacatttgctaggcaagccaatgttagagattgtttaaccatttatgttcatttttagtaattaatagcaattaaagaaaataaaacggaataattgtaaagtaaatatatgcatcaaagtcatttacatcctatttctccccagaaacttggtgtcacaatttcatgaacacactatgattttctacaaacatgagtctgaaagaaatttacatctgtttttggaatgtaagaaaaacagtaataaagggatatagaaggggacgccagggcctgcggacgccagcatgactaccttgggtctccaactatgaacctaagacaagtctctcagtaagccacaacctgctacgaaatctgcacaagaggtgcagagtgcagtatcagtacaaccgaccccatgtactagtaagtgccgagtctaacctcgacgaaggtatgacgaggctatggcggaacacccacgatataatatatatatatatatatatatatatatatatatatatatagagagagagagagagaggggggggggggggaaacagtaatttaagcaataaattgcaagaataaataattacgtaatctcagtgtcttatccatattcagctataaccaatccttaagaaaaatataaaaccatcaaataatttacacggtcaacaaaaaattaataaagcgtatgctgatgcggcgtgcatccagatcctaccgatcctccacacacacacacacacacacacacacacacacacacacacaatatatatatagtgtgtgcgtgtgtgcgtgctcgcgcgcgtgcggcaacccgatcccaccatataataatatcaaacataataattcacccttattacttcgtttcaatccacccttgttcctcctgttacggcgtacaacccgatcccaccgaatattcacattcacccttattcctcctcataaatactcccttattcctcctgttgcggcgtgcaacccgatcccaacatatcaaaaataaattccatgtagtgtatagaaatttatgaaattcacacaagacccttttccaacacttgaattttagagcaaagcaaccgaaagttgtataaacaatgaactcaataagattactactactcagtgataccaaaccaagatatcacaggaaatgctaataaaaacagtttaaaccaaataaggggagatcaataaattctaccaggaaacaaatattcaacaggtaacgattaatcacagaattatagttagacaggtaacaagtaaagcaagaaggggaacaatataagggaaacaaatgaaaataggtaaaacatgtaaattggtggcgcataggtactcattacctcacatatacgccgctcacatgatttatcacataacaacaattcaaaacttcctaaaccctcaagtcaaggttagacacaacacttacctcgctccaaatatcactcaacgttcaatcacagacttgcctttcaaattagcttctgagccaacaatatctagcaaattaccaaccaaatgattcaaaataagccttaggaatcatccacgataactacggttcaatttaattcattttcgaaaaagtcaacaaaagtcacaccttggcccgcttggtccaaacacgaaattcgagccaaaacccaattacccatttacccacgagcccggatatataattggttttggaatccgacctcaatttgagaactagaacccaaaatttcgaaatacctagtttctacccaaaactcacaaatcccaccatgaaaaccttagattctaggttgaaatcttgtaaaataaagtgaaagattgaaataaataagttaataatcacttacctatgatttagggaaaaaattgtctttgaaaaatcgcctaaagggtttctaatgttttgaaatgttgaaaaatgagaaaaatcccatctaagtagagacctatcagctacagatgtcgcatttgcgaccagagcttcgcaatcacaagtgcgagaaatatcacaaatgagaactcttcgcattttctgcagctctcgcaaatgcgaatagtagccttccgcaatgcggtctattctcgcaattgcgagcctacccagcctagtcccttgctcgcaaatgggaggctcgctcgcatttgcgagccagacctcgaaaatgtgagatctatagacctgaactcacaccagcaattctttctaagttcttttcactctgtagcctatccgaaactcacccaggccctcgggactccaaaccaaacatgcatacaaatttaaaatatcatacgaacttgcttgtgcactcaaatcaccaaaataacacctaaaactatgaatttagcaccaaaacatatgaaattctcaagaacacttgaaatttgtagtttatcaaccggacgtccgaatcgcatcaaatcaatttcatttttttaccaaatttcacagataaggtatgaatatcataacggacctgtaccgggctctggaaccaaaatacggatctgataccaatgaaatcaaccattaacgaatttcttaaaacctttacaatttcactctttcagattctatcaaaaattcatttcttgagctagggatctcggaattcgattctgggcatacgcccaggaccgtcggaacacaggtccgagttcgtttactcaaaacattgaccaaagtcaactaaaatcacttttaaatcaaataattattatttattcaattttttcacataaaggctttttggaatacgcccagactgcgcacgcaaattgaggtgggtaaaaatgagatttctaaggctaatgagtgcagtatagggtcttaagtcacaagatgaccctttgggtcatcacaatctccacctttaaaacaaacgtttgtcctcgaacgaacatagaaaagtacctgaactggcgaacaagtggggatatctactccgcatatccgactcggactcccaagtagctacctcaacaggttgacccctccactactctcggtctaaaggataactcttcgacctcaactgacaaacctgccggtgtagaatggctaccggctcctcctcattactcagatccttgtttagctggacagagctgaaatctaatacgtgggacgggtcaccatgatacttcccgagaatggacacatggaatactggatgaactgaggataaccctagaggcaacgcaagtctataagccacctctcccactctatcgagaatctcataaggtcttatatatctagggctcaactttcccttcttcccaaatctcatgacacccttcatgggcgatacccgaagcaatactctctccccgaccatgaataccatatcacgaactctatggtcgacataactcttttgcctggactgagctgtacgaagtcgatcctatataatcttgaccttgtctaaggcctcctgtactaaatccgtacccaacaaccgagcctcccacagctcaaaccacccaaccggcgaccagcaccgtctaccatataatgcctcatagggagccatctgaatgctcgactggtagctgttattgtaggcaaactctgcaagggcaagaactgatcccatgattctctgaagtctataatacaagcacgtagcatatcctctaagatctgaatagtacgttcagactgcccgtccgtttgaggatgaaatgttgtgctcaactcaacccgcatacccaactcacgctgcactgccctccagaagtgcaaggtaaactgcgtacctcgatcaggaatgatatagacgggcacaccatgaaggcaaacaatctcctgaatataaatctctgccaaccactcagaagaataagtaactgccacatgaatgaagtgtgctgacttagtcaacctatccacaatgacccaaacagtgtcgaacttcctctaagtccgtgggagtccaacaacaaagtccatagtgatatgttcccacttccactcaggaatctctatctgctgaagcaaaccaccaggtctctggtgctcatacttcacctgctgacaattcagacaccgagctacataagcaactatatcctttttcatcctcctccaccaataatgctgccaaaggtcttagtatatcttggtggtgcctcaaggaataactcatgaagcccatcaacattaggcacacatacacgaccttgcatcctcaaaacgccgtcatctccaacggtaacctgcttgtcaccactgtgttgaattgtgtcccgaaggaccatcaagtgcgggtaatcatactaccgatctctgatacactcaaacaagggagactgagcgattgtgcaagctagaacacggctgggctctaaaatatcctacctcacaaactgattggccaacaacatacccagtaaaatcccactagtggggtctgaggagagtaaagtatacgcagaccttacccctaccccgaaaaggatagagaggttgtttcgggagactctcggctcaacaggagagacaataatatcagaaaaggaacaaaagaaaaggcatgtaacaacaaaagatgccagaaagaaaataacaacaacgaatatgtgaaagaacaataacacaaaactatgcaaaataacaatgtgaacacaatatagaccgctaacaaacctaaacaaaactctaccagactacccggaacaaagagggaagaactctcggctaccccctagcctactaccctaatgctcgacctccatatgttcctataaagaaccaatttttattggccaaagtcaaaatatctgaagctagcggcctctcaccgactggaatgaacacaaggctgcccatactcactgccttcctactcaatgcatcggccaccacattggcctttcccgagtgatataatatgatgatatcatagtatttcaatagctccaaccatctcctttgcctcaaattgagatcctttttcttgaacgaatactgagggttgcgatgatccatgaaaacctcacacgacacgccataaagataatgcctccaaatcttcagcgcgtgaacaatggttgccaactctaaatcacgaacagggtaattcttctcatgagctttcaactgctgagacacatatgcaatcaccctgccctcctacgtcaataccgctccgagcccaacacgggaggcattacaattcatcgtgtaagatcctgaacctgagggtaatccaacatcggtgttgtagtcaaaactgtcttgagcttatgaaagctcgcctcacactcatccgaccatctgaatagggcacccttatgggtcaacctggtcatcgaggatgctatagatgaaaacccctccacaaactgacggtaataacccgtcaaacccaagaagctcctgatctccgtagctacagtgggtctaggatggttattgactgtctcaatcttcataggatctacctgatagcgactgaatccaacaaaaactcgcacttcaaaaatttagcatacaactgactgtccctcaaagtctggagcactatcctgagatgctgctcatgctcctctcgacagcgagagtatatcaaaatgtcatcaataaacacaatcacaaaggaatccagataatgcttgaactccgattcatcaaatctataaatgctgggcgggcattggtcaatccaaaggacatcaccagaaactcatagtgcccataccgcgtccgaaaagctatcttagggacgtcggatgtcctaatcctcaactgatagtagccagatctcaagtcaatctttgaaaacaccttggcaccctgaagctgatcaaaaaaatcatcaatcctcagcaatggatacttgttcttgatggtgactttgttcaactgccgataatctatacacatcctcattgacctatccttcttcttcacaaataaaaccggtgcaccccagggcgagatactaggtctaataaatccttatcaagcaagtcctataatttgttccttcaactctttcaactctggtggggccatccgatatggcggaatagaaatgggctaagtacccggagccaaatcaatgcgaaagtcaatatccctgtcgggtggcatccccggcaggtctgcaggaaatacctatggaaactcatgaacgacacgcacccaatccatagagggaacctcagcactagaatcacgaacataatccagataggccaaacactccttttcgaccatacgccgatccttcatataaaaaataacctttttggaagaatggccaccatacgccgagcctttatataagaaataacctttttggaagaatggccaagagtccctctccactctaatcgaggtaaccccggtaagtctaaggtcactatcttggcatggcagtccaagatagcgtgataagtaacagccaatccatgcccaatttaatatcaaaatcaaccatatcaaggagcaaaaggtctacattggtctcaagactcccaatagtgaccacacatgaacgataaacacaatctacaacaataacatctctcataaatgtggacacatatacaggggcactcaaagaattgcggggcacaaccaaatatgaagcaaaataagatgacacataggagtaagtagaccccggatcaaatagaactgaagcatctctactgcaaactgaaatagtacctgtaatgacaacatcagatgactcagcctcaggtctggatggaaaggcataacatcagggctgacccccaccactctaaaccatatctctaggacgacctctaactggcgggcctccatctctagcagcctgacctccacctctaaccatctcacccctacctcgaactgcctgacccctgcctctaaccggctgagcaggcggtgcaataactggcgccagaaccatagaacgagaaccttgacgttgtggctgaacacccaataacctcagaaaggtctttcgaatatgcccataatcaccgcactcaaagcatccatcctgatactgtgacaatgagaattgagactgacccgacgagccggctgaccacgataataactctaaagaggaggtgctctgataggagctggtggtgcactataggttggcttcccagaaggaggcacataagaaccatgactctcggaagcattgtgagatatctgaagtgccgaatgaaatggcctaggaggatggcctctaccaaaagcacccctgcttccagatgaggcgccgctgaacacaccggaatgacgaggtctcttatctgaccctaacctccctgtccaagaaacatcccgactcgcctggccacattggtcgtatcctaaaagtaatcccgctcccagtattattagccatctgcaatctaataggttgagcaagtgcctcaacaaacctcctcatcccccctctctgtggggagaaaaaaacaacatgacgagtcaaatccacaaaacgagtctcatgctaagtaacagtcatgctgccctgctagagatgctcaaattgacggcggcgcttctctctcgtggtgataggaaaaaacttctctaagaagagatgcgagaactgatcccaagtaagagtaggcgacccatctggtctagtcaacaaataatctctccaccatttcttggcggaactagtcatctgaaaagtagaaaaatcgaccccattggtatccaatatacccatgttcagaagaacctcatgacaactatcaagatactcctgggatcctctgaagtagcaccactgaaatgaactggaaagatcttgataaacctatccaatatccacaaagcctaggaagatatagctgccccatcaccaggctgtgccgcagcaaccggctgaactaccccgattggatgagctgttagggactggaactggggagcaatctgctccagagtatgagtagcaggagtctgggctcctcctccaacctgagatacatatggtgccatggggaatgcgccagtctgggtcacactctccataaggcccaccaatcgggcgaaaacattctggagcactggggggcaataaacccctcggggacctgagctggtctggtaggaatagcctgagctagaacctcctcatcgaattctacctgaggctccacgactggggctgctgctcgggctctaggctaagccctgcccctgtatcagcctctggcatggcctcggcctcgacctctgcgcctcataggtataacgacccggccgtcgttccgagagtaatagccccatttcccccatttctacttctctatgtgttgtttagtcttattatgtttttctttgggttggttggtccgggttcggagtgattttaaaggaaatgaaacacttagtctcttaattgggaaatttagttggaaaactcaatcgaaagttgacttatgagtaaacgatcttggattagggtttttatggtacggatagctccgttacgtgattttgtacttaagaatgtgtgttcagaatgttatttaaaggtccgttgtagaattaggcttgaattggcgaaattagaaatttgacgattttctgatcgttagtggaaaattagatatcgaggttggaatggaattccggaagttggaataggttcatagtgtcatttgtgacgtgtgtgcaaaatttgaggttattcggacgaggattggtaggtttcggcgttgtttgcagaattcgaaagtttagaagttcttagacttgaatccgagggtaatttgttattttttatgttgtattgagtgattcgaaggctcgaataagtttatatgatgttatgggatgtgttggtatgattggtcggggtcccgaggggtcgggtgagtttcgggtagttccggaccatttctaggccatttttagctgctggtttttggcaacagtagtgtgctacacgatcgtggggaattgttcacgatcgagatgagtaaaatgagagaaaatggtcagtgaaccacgatcttggaagtccttttgcgatcgcggaaggcctttcgcgatcgcgtagaggaaattttcttactgcattgacccgaatttagaagcttgtatcgtgaatctataaagaatttggagatgattcaaaataaaagtttagctctttgtgtctagtttttattaaatcataccattcagaatttggagttgtttctaaagagttatgattgatacactacagcctatctaggaagagtttggaaatcgcattgtgtttcatagggctgactttggcggcttatatctcataatatataaggaactgggaaattataaaagaatgaaagatatggctcttagtgtctagtttataaaaattcaaatcatttgcaatttagagtttcgtacaaaatgttatgactattatactagaggttgtatggaagagtcgggcatttgtttttcgcgatcgcgatgcattttccgcgatcatgaagggaaaattttgggctgagaaaagttgtgcttcgcgatcgtggagcattctccacgatcgcgatgagtaaatacctaggcagaagctatatatcgaggtctcagccatttttaacatatttggagctatggagctaggattgaagcgattttcaccatatggaatggggtaagtgatttctatttaatttttgtcgaactccatgattatgcttttaatttcataatttaatttgtgatttgaggtggaaaattggaaaaaatggtaaagaattcttgagttggatttttggggttttgaatgggattttgttatcggattggagcaaatttgatatgattggactcgtgagtgaaaaaggtttctagttttgtaatttttgttggattccaagacgtggatctggggtcgggtttggccaattttgggatttgtggtttaattggataatttttatgcgggcttcgttcctttagcgtatattaatgataatatactgattttggataaattcggagcgatttgtggccgaagtcaagcggcaagggcattgagaagtagagttttgtcctgtttgaggtaagtaacgattgtaaatatagacctgagggtatgaaaccccggaattttgtaccatttcactatattgaggtgacgcacatgctaggtgacgggagtgtgagcatgcaccgttaggtattgtgacttgatccgtcccgtagcgactatagagttgcatattttgattaaagccgtataatagctatatgtttagaaagaattcttataacttgggttgaataccacatttagggccttgtgcctgtactgtttggaacctcaggggtattttgttactatcctcacactgttttgattcgaaagcatatcctcagtcatgattttacatgtttattgtttgattcagtttcattactctattttaaaagtatatgaaagttgtttaggcctaagtccgttgatttaactgaaacacccgagtggcttgtgaggttgatgactgagtgaggccgagggcctgattgtgagaatatatatatatatgaatcgggctgcacgctgcaatgatatatggatcgggttgtacgccgcaacgatatataaatcgggatgcatgccgcagcgatatatggatcgggttgcatgccgcagcggtattgggtcgggccgcatgccgcagtgatatagcgcttgggatgtaggagcccctccggagtctgtacaccccgaatgagcccatgtacctactgagtgcgagtgatgatgatgagtgattgggaggcataagtggatgtgaagcttgcctgaggggttgttcatgagtgatattttgcccgaggggcttgtttatgaaatcattattttcactctattcttatattgagcctctattgaaaatgttgaagatattcgtacaggtttccattgaaactggagttttaagtaatattgtgaattgaacattgattttacacttgttgtttcattgagactttaaaacatttgaactttacgtgatttttttactactcgtcactgcacttagtctttatttatgattgttacttactgagttagcgtactcacattgctccctgcaccttgtgtgcagatccaggtgccacaggacatctgagtgagtgttgattcatcctcggtcgatttcggagtctagcaaggtagttgcacggagaccgcaacctttctcttctccctcctatctttcagtagactatttttattagaacttttcttgtcgtttgggtagactgtatccgacttgtatcatagatgctcatgactagtgacaccgaggtcgagccgttagttttatgtttgtttactttcacttgtttgaattatttaatgaaagatttatgacgaaaaagattaataaatgaattattgaaaagaatcattgtatgctttggataacgactcagctagcctaatactgtgataggcgccatcacaactgggtagtttgggtcgtgacagtagaagctgctgctggaggctctggctgctgattagcggaagatgcggtacgtgtcctcaccatctgcgagagaataagaataggagagttcaatcagtatcgagataacaaaatcgcacgatagagttgaataaaagtgaaatttgttcctagacttcatagcctctaggagataagtacagacgttttcgtctaccgatcccccagactctactaagcttgtccgtgaattatgagacctaagcagcctagtgctctgataccaacttgtcgcgatccgaaatttccaccgtcgggatcgtgatggcgcctaacgttacacttgccaggcaagccaatgttagagattgtttaaccatttatgttcattttaagtaattaatagcaattaaacaaaataaaatggaataattgtaaagtaaatatatgcatcgaagtcatttatatcatttctccccagaaacctggtgtcacaattgcacgaacaatacaaacatgagtctgaaagaaaatttacatatgattttggaatgtgagaaaaacagtaataaagggatatagaaggggacaccagggcctgcagtcgccagcaggactaccttgggtctccaactgtgaacctgagccaaatctctcagtcagccacaacctccttcgaaatctgcacaagaagtacagtatcagtacaaccgaccccatgtactgataagtgccgagactaacctcgacaaaggtgtgacgaggctacggcaggacactcacgatatgtatatatatatatatatatatatatatgtatgtgtgtgtgtgtatatatatatatgtgtgtgtggtgtgtgtatgtatatatgtatgtgtgtgtgtgtgtgtatatatatatatatatatgtgtgtgtgtgtgtgtgtgtgtgtgtatacacatgtatgtattacagactataaataataagccagaaagggtgaaacagtaatttaagcaataaattgcaaaaataaataattacttaatatcagtgtcttatccatatttagctataaacaatccttaagcaaaatataaaaccatagaataatttacacggtcaatgaaaaataaataaacacatatactattgcagcgtggatcccgatcccacaaatcctcccttattcctctgtaacaattatattaaaggtaatatatatatgtgtgtgtgtgtgtgtgtgtgtgtgtgtgtgtgtgtgttgcggcgcacaacctgatcccaccatatatcaatatcaacataataattcacccttattactccatttcaatccacccttattcctcctattgcggcgtgcaacccaatcccatcgaatattcacattcacccttattcctcctcataaatcctccattattcctctcgttgcagcgtgcaacctgatctcaccatatcaaaaagaaattccacatagtgtacaaaaattcatgaaattcacacaaggccctttaccaacacttgaattttagagcaaagcaactggaagccgtataaacaatgaaactcaataagattactactactcagcgggaccaaaccaagatatcatggaaaatgctaataagaacagttaaaaccaaataaaggggagagcaataatcctatggggaaataaatattcagcaggtaacgattaagtacagaattacagttagaaaggtaacaagtaaagcaagaagggaacaatataagggaaaacagaagaaaacaagtaaaacatgtaaatttatggcgcatagatactcgtcacctcacatatatgccgctcacttgatttatcacataacaacaattcaaaacttcctaaaccctcaagtcaaggttagacacaacacttacctcgctccaaatatcattcaatgttcaatcacagtcttgcctttcaaattagcctccgagccaacaatatctagcaaattaccaaccaaatgattcaaaataaagaatcatccacgataactacggttcaatttaattcattttcgaaaaagtcaacacctaggcccgcttggttcaaacccgaaattcggaccaaaacccgatcatccattcacgcccgagcccagatatataattggttttggattccgacctcaatttgaggttaaatctccaaatttcgaaatacctagtttctacccaaaaatccccaatccctccatggaaaccttagattctaggttgaaatattataaaatgaagtgaaagattgaaagaaataagttaagaatcacttacctatgattcaggaagaaattgcctttgaaaaatcgcctaaagggtttctagtgtcttgaaatgttgaaaaatgagaaaaatcccgtctaagtagagacccatcagatgcaaatgtcgcatttgcgaccagagcttcgcaattacaaaggtcgcaaatgcgagaaagtatcgcaaatgcgaactcttcgcattttctgcagctctctcaaaagcaagcattatgtcgcaaatgcgaacagtagccttccgcaaatgcggtcctattctcgcaattgtgagcctacccagcccagtcccttgctcacaaatgcgaaacaatatcgcaaatgcgaggctcacatttgcgagccagacctcgcaaatgcgagacctgcagacctaaactcacaccagcaattctttctaagttcttttcactctgtagcctatccgaaactcacccgagccctcaggactccaaaccaaacatgcgtacaagtctaaaaatattatatgaacttgcttgtgcggtcaaatcaccaaaacgacacctataactacgaatttagcaccaaaacatattaaattctcatgaacactttaaaaatttcattttatcaaccgaacgtccgaatcacgtcaaatcagttccgttttttgccaaatttcccaaataaggtatgaatattataaagaacctgtacggattccggaaccaaaatacggacctgataccaacaaaatcaaccattaaccaatttcttaaatcctttataactacagtattttaatttatcaaaaattcatttctcaagttagggacctcagaattcgattacggtcatacgcccaggtcccatattttgttacgaactcaccaggaccgtcagaacacgggtccaggtccatttactcaaaacgttgaccaaagtcaactaaaatcacttttaaattcaaaaaattattatttcatcaatttttcacataaaggttttccgaaattacgctcggattgtgcacgcaaatcgaggtgggtaaaaatgagatttctaaggctaacaagcgcagaatagagtcttaaatcacaaaatgaccctttgggtcatcacatcattgctcctttcgacagggtctcttcgaactttttcaacaacatggactcgacctcgtcgtcctgcagatcattacccttaatggcgcatgtgtaagaggcaacatgcttattggggtcagtggtcctgttatatttgggtatgtcgggcataccgaacttctttgtaatgcacttagagggaatggtctttgcacaaacttcttcgaatccattcctttcaagattgttggtgcccccagtatctgattaactcgggagttgtaaatctccatctttttatcattgacttcgattttcttctctcctgattcaattctcttggtgagctcctcgaaccattttcattacagcaagatcgatccccaatgtgtcatcactcgagctttccggtactggctcagtacggcgagtagtctccggctcgaccctatttggagctttatgctgattttgtaactgagcaatggcggcttcttgagcctgaagcatttcgaatatcacttggaaactgactcctttctctcctctgccctgtatacctcggccatcagatcggccttctctgcatatactcccctcgggatctggccctaagtccgccttcgagcaacgtacgaactgacgtcgacttggttgatgggtggtactcctccgagatcagcctgtggcacctcggttcctggagcaatcacatttttcgttttcccgtgaagttgaaggccattgtcaccgtgtgtggacgcgttttgtgagtttgacatgtttgaacctgaaagcaaaaattcttgacaagaacaagcgtaaattagtgtgtttaccagaatcaatactgaataatcactattatccttagccccacggtgggcgccaaactgtgtaccctaaaattcgagtaacaattaaacttgtattgtaattttaaggatatgtgatctaatccaataccaattgataactaatgaattaaatgaataatgttgcacaacaaaataaaccaaaccagaattgtagcagtgtatcgagctcgattcgagatggtctcgaggttggaaaataagaacagtgaagaaaaataatgaacagtaagagaaatagagtaacgtatatatttttatcagtgaatgataatgatataatgaatggggtccctctttatatagtagatgaatcctaaataaggtacaactctaataacagaaataaatcccatgattggtgtcaataaccgcttgatttgatctgttccggaattttcgccgagatcttcggtcagctgctaatatctcgccatttcgttattatgccttactcggagtcggtcatgctcggtctcgatcttcaatgagcacttcgatcttcacgctccatactctgccatcgagctcgagccaggtccattataagcttactctgaggcagctcttaatacctatgaaatcggacatgcccgatttcgaccgttatacattactctaagggcaactttggaaaaaagaagttatttccttcgtggtatttaaaaaaatctaatattaaggacaacaaaaggaccaaaaaaattaattaaaataaactggattaactataagctaatatcaagtgttagaatcataatggaattacaaggaaatggatgttcagtgtataatattttgatttagatgatttatataacattgtgcattttgaaatagccctcatcttgtgtacaatgtttagcaaattacggtatatacctgtatattgtatacggtccaattgtgaatacattacttataatttaaaataaaaatatatattatatgaaccttcaagctagttaatatctttaacacagtgtctaaaagaataatttaacgggtttggattcgctccaattacgaatgctcaagtaatattcaatatatgtcttgattgaagctattatgaaagttacagagattactggagttttaattaagaaaaacattattaactacaatattatttgtttgcaatttgccattgtagaaggatattaagaatttgctttagaactaagaggaagcattttagctaaaacaatgtgttgtataggctaaaatttgcccttaggatatttcgcgtaatatgacattaaggaaagagttggtcgggctcgtccaagatgcatcaaagtcattggccgaggtgccgacacgagttatagtcgagatgtcaacatggatcaaggtcgagattgactactgatgataagagttgtaacgactaatttgtcagttaggatattaaaagggaatattctagtggatattctctgcatttgtactattagggtttcctaggaaaatgcttcatatatatatagaaagaagagacaatgataaaggtaagtaatattcattttgataagaacattttcgagaagaaggttctctctctctctgataaaaacacaaagattaccttttgataaagattgttgctcatattgttcctcatctttccaccagatccgagaattgttcatacgaatcttagacctttctgtcattcatcattgtcagaaaaaatattcgttaaattcatccattattaggtgaatcattctccttatttacttaaatgtcatttattaccacttattgtttgttatatctccattaatgctcatgcttcaatagtatttgcacttattgtcatcactcatttacgggatctgttcccatctcttacacgttttcgagattaacatctgcaatcatttttaattagatttaacccattattatctaaatataatagtttaagctgaagttacatttattggtcaaacatgtataaagctgcttagagtgatttactcgaatttatgtaattttaaacttagtcctagttaaataaagagggctggttagtcattatatcacgcactcttcaatacgtacttacttagcatggtcgttaaatcaatatgttttctactttcaatttgtattggttttccaagcttatgtgaaagcaataaataattttcagttatttatttattatcatcctgaaatgagttaagttatgcgagtatttatatatggattacgtataattttataacaagataatattatttacgagttattagtgtaaaaaggttattagatttgcttagttagagtccaaataatgtgttgtttggtgaagaaagggatggaaaggttggatatgtgtctcagttgagggatgaaacattgtgtttactctcaatgttaaaaataaaataatattttggttatggtcaaaagtgcaccattttagtaaaaacttatggactattagtggtacaggaaaaagaatgtggatgattttgagaccaaacacaaagataatggactattttaggctttttcagttttctctttgaaacttgtaggattagaactgcttataaatcgcacttacattggacttgcaatcacattcggatgagccttgtaactcgcatttactaaatacgatttataaaccgtacttgtcaaatgttaacttataaatctcactcataaaatatgacttatagaccacgctcttaacatgcaactcataagacgcatttgttatgtgctacttataaatgataaatctgtaattatacaacgtataaattgcatttggcactcttaaaaacattgatggaagacgacatataaattgcattcactatatttccaatcttatttgcaagcacaaccatatcaccttgtatagctaaccagtttcgtgactttgcgtagcttacaacattgcaaaaagggataatctttcactatttagatgtcttcgaaggagaagtcccacgaacttcttctccgaaggtcaacctgtagttcatgttcctgggagaagtagaaggagttcggagcgccctttggccctaagaaataagcggcgaaagactttagatgccttagaacccttgagacagaacttttctgttctttcaattgcagaacccttctccattggcatatcttgcaaagaagacattaaaaaactatgaaattatcaaatttattctaactatagaaaaaatatcatattatagtgtatttgcatgaataggtcatatgtttttaaattaaatacaagtcataagtaagacaacacctcgaaacataagaagtcgttctaatacatgtttaagttagacaacacctcaaaacatacaaagtcgttctaatagatgtttttgacgcacaattgataatacaaaatcaaccaaaagaatataacaaagtgcacactcaacaatatttgtctttgtaggaaatattgagtccactcataaggggtgctttaagacccaatagggttattagttagtatttttctatgcgctgtttctctctatcaatccaaacgagggtttagactgtagaattacgagggtttagactgtggaattgggggctgttctaactgtggaattgagggttgttccaacacactgtgacaatcattgtcgaccagtaattccagcctcggttcgttcgttacttccgcttctgctacgcgaacaaataagttctcgttttacgatttatgcattatctaatgtatttaaattaacgtgtttcttcattggtatcagaaccatagactagctttctggtccagaaaaataatagataaattccgtcttttattgtgaaacacataggtgtttctattttctggtatcattgaaatgaataaataattttgttacactatttttagataagtttttaaatcagtgtgttaaggtttgaacattgattttgagaaaatcagtgcttataatttttcgtttaatctatcattgttttaatatcaactcttgtttctgaagaaatatggcttctccaattttctaaacactgccaaaaaaataagaagaaacaaaggttattcttataacatagtagcggatgaaagagatgaagataaattagagttttatctctttctctaattcgaaaccattatactatttttgttatgaatagaattgtaatcaaagtgaatatctattttttagagagttttactttgtgcctaagttatttgtcccctataactagaggagtcttaccccattgtaaatcataccaaaattcaataagaattccatctctctctttctctgtcatattgttcttcttcttttattgtttcataacacgttatcagcacgagactctaaccaattgagtagaagctttgagattaagcatactgattgtcaattgtttcatgaactttcttcatgattaaattccgagtacaatgtaagtattttactttatttttctcttttaaattctgaaattctataatttgattttaaatacatgcaaagacaatatactttgattataactcaaataggagtttgcaagaaattataaccatctgaaatggtaaaatttctatgccttgccatgatcaaattcatgtatgattgtgggcaaataagtgaaaactcgtcccattgaatttgctcattctcattcccttagagaatgtgatagcaatagtataagtctgaaaaagacaaaattattaccgtgaaggtatcaatggatgtagacgtggcaatagacgaaattataatcgtctcattgtgataatgagaataataaggattctcaaaataatccttcactttgtgaaagtaatatttgtcatcgatttgacatgagattttataagcacatatagtcgattttggttcattcatgttgtgaatgtaacaacatctgattatgaatacatattcttcttggaagaatatgaacgtgctagtggtagttaatataccacactcgcctctagaaggaggtttgagaggaaataagaaaataatgtcattattatggcatgaatgagcattggtcacatacctattgtacgccaaaatattttggtaatgtgattattaaaaataacagcaatgcaagaaacagatcttgcatataattttgaccatgacataatgtataactttctctttaaaaggatattcaccacataatgttgatgaatatgtggtagtaccaaattaattgagagctctggaagagccaattattactattttggaggaataaaattaattatcaataaagtattgtgttgtaaagtctcaaagaaactaatttagtttctaaagtattcgcgaaagcgattggttatactgagattataaataaaggaaagatttactatcttctattactacaacttgtagcgaggtaatatgtatgtgaaaagttgtccgctttattctccagtttgtactacacaagtaaaaaaaccataataagtggatgtttattgatataaaaacctatatcataataaacttggagtttattgatataaaaacctatatcataataaacttggagtttattgataattgcacatgatagtgtaaactgaactttatcaatattgataatttattcagttggcataattggtttgccatatcaattcaagtatgatgtgcaaaagtaaaagagtattcacatgggtaaatattaaagaactagaaagttctttacaaattctcttatgttgctcgttctcattaattaatagaccaactaaggattgaatcccataaatgcttgaaatataaaaggtgaatatgagctcattcatctgccatgtatagcacataagatgcatctatgatggttacatgtgcgattattattaacccgcaacctggtatttgaggtaactttctcaataatttaatttagagcataatttccagattttctattcaagacagttcatcttgataaattggtttacatcacagttggtttagcaaaattatttattgagtgcatccacttaatagctaaactattgcttatgagaacgaagttatttatatcagtttgataatattatacacgaaagtatattacattctcctctcacaagtggttcagggtcaggaaccaaataattccatcttattattattgatgtgcgtgtatattttgattaataccataatgcacaaagatggattcccaaatttaaggaagaaagttggtttttctaatatgaggggagacatgataaacagttgagaaaaagttacgtggaaagaattatcatttctacatctaatcctcgaataagataatatgaacttgaagtttataaaaggataattcatctgcaatatattgtaaagcatgccagacgcatttgctgatccaaagaaagtaactattttctcattgcaaatgttcatattaagtcttagaaggacaaagtctatggtacgcttaaagcgtataaacaaatcggctcaaataaacttctgataaagaagatgagcaaatgatcaaaatgattataataaaagagacaagtgatcaagaagatcacacgacataacacttcataaaatctcaagagagattcaggtacctgaatatatcaatgaagagatctctgtgttatgtctttatggaaaaaaaaatattggaactgatataaaatattcgtcgatgacatctatgatagcgctaagtatagatgaggatcttaagtctgtcgaatacacacacaaaaatattggctaaatagaagagacacaattataatagaattagtttcatatgaaatacgtgtaattttggacatgtagttcaaacgctcaaaagtataaagtcaatggtgtgtgcaatcactttcatgtatcttatatgtctagcatgacatgaaaacttgatatgcatctaaagtctttttatatggcttatatgactcaacttatatgacaaatccttgaagatattgcttaaagcatataaaattcttggtcatgaagttactatatcctaagtgcaatttgtgcacatttctatcttgctataattataagcatgataatgtgatagcgaggattttcaaggtgcagcatattcatttaagttaatatggatgatttattcatcaaacctctggtgacatcaaccttcaagaagctagtgtacaagattgggatgcgaaggctcaaggatgtgaattgatgctctcgtcagggggagttaatgcgcgttgcactctttttcccttacaaggttttgtcccactgggttttccttgcaaggtttttaacgaggcaccaaaaggcgtattgttagatatgcgtactcttttttcttttctagaatttttttcccttgggttttattttagttaaggtttaacgagtcacattatttattgaatagacattcaagatggagtgttatgaatagaattgtaatcaaagtgaatgtctatcttttagagagttttactttgtggctaagtcattttttccctataaatagaggggtcttaccccattgtaaatcattccaaaattcaataaaaattctctatctctttttctgccatattgttcttcttcttttattgtttcatatttttttttttaggaattagggatttaaccagcttatctttcaaagtggacaaaactaaataattgggctgaaggcctatttaaaattgcaaagttgatggttaaagatgcatgggctaatttttgtagatgttggaagatctttgaaaatgggcttatggcccacgttatgctaaagctaatagctgaagcttgggcttcttcctattcttaatgatggcagagcttttatgggcaaatggcccactttatgtcttctttaatttaattattgggctaatggcctaaattaaatttaaatttagttctgtaatttttttaataaattccagattactaaaatggtcatatggacctaatttcagaatataaatttagtatttatattattttaataaaaattagaattattttactatcccaatttcttgaaatgttaattagtttaatattaaacttgcttattaatttgtttaacatgcttaaaatgttaattagtttaacattgtatttatttattaatttttttaacatgctttaaaatgttaatttgtttaacattatatttacttgttaatttgtttaacatgtttaatatgttaattagtttaacgttaaagtaaatggtatgtgaatttatatgcatgtaataaatgttaattagtttgacattaattttatttgcatgctaatataagttattagttaacttatgattcacatgggattgtaaaatcatgatagataattatgttgtcttaaacatgatcaagacgcttagctagataattgaataggttaattttcataatattttaaattttggataatgattgggaacatagtgaacattcgactccatgattaatatatgtgtttattaacttaatcagctgatgcttagtgccataatatgtatgtgtgttgaacgtcatgccttgcgttatttttttcgatcctcattttgttttttattttgttaaataatgaatactgcttcgaaaaatactgttgctgagctcaacaaaggattgaaactcaatggtgacaactataaaacctggagcttgaaagtccaatatgtgctagaggagcaagaggctctggaggccattaacaatgtcatgaatgagcatgaggaaggcacactgcctcagcataggcgtgagggtgaagcctatgacagttggaagaaaaagaactcatttgctcgcattacgttgttgagcaccttagatgatgtcattctaagggagtttaaggatcaccaaagagctatggatctttggaatgttttgaggaaaagatttggtatctgttccaccgaaaggctgcaatccttaacgatcaaatttgactcatataagaaacacccagaatattcaatgaaaacacatatgaggcaaataacaaatatgatcggggagttgaaagatgttggtcatgtgttgactgatgaacaacaaatccaagctgtcatacgctctttacctagttcttgagatcatatgaaaatgcatttgacccataatgaaagaatcacaactctagaagatttccggagacaccttgagttagaagagaaacgatttaaggcctgcaaagccaatagctgagttgcacatggcaacaacctccaaatccaagagtgattcaaagaaaaggaactgggaaaagaagagagggtcaccccaagttcagcctgctaaaagagcaaagactgaaaatggcaagaacagacgtcccaaacttgtcaaagttgctaaagtaaatgcaataattgtgacaagtgggtcactatgccagagattgctctgagcctcctagaaaggtatttcccgatgctcgaattagtgaactttgtgtttctagttctatttctctaaatgaatctaatcctttgtggattgtagactcaggagcaacagaccacatagcctggaaacgcagtgcctttgttgaattttggagagttccacgtggagcaaagtagatatatgtgggcaacaacaataaagttgctgttgaagggataggtacatgcaaattagttctgcgtggtggtcgagacctaatactgcatgatgttctctttgcaccaacaatttgccggaatgttatttcagtttcagttttgcttaagctaggatttgacttgttttgtcacggcaattatgtcaagttgacttttggttcaactttatttgattttggttaaaggtttaattattatgggtttggattatgattcatttaataataatgctagtttttcagtttttgtttcttcacataaatatggtaggtgatgtaaacatatggcaagctagacttggtcatattggccaacaaagaatgcaaaggttagtaaaacaaggtttgctttccagcattgatcatgtggaattgtccacttgtgaaaattgtctagctgaaaaatctgcaagaaaaccttttggttaggcgactagagccgaatatcctttgcaattagtccattcggacatctgtgggcctatgaatgttagggctaggcatggagcaagttatttcatcacatttattgatgactttacccattgcagttatgtctatttgatttcccacaaatcagaagcaataagttgcttcaaacgctatatgagcttagtggaaaatcaattagaaaagaagataaaagctcttcgaacggatcatgctcgtgaatacttatcaacccagtttaataatttatgtgatgaaaatggaatagtttatcaattgactatcccaaatactccacaacaaattggtgttgcggaaagaagaaacagaacgctcctagaaatggttaggtcaatgatggcacaagctaacctcccaataagttactgggtgatatgttgcttactgccacctttgtgcgtaaccgagtgcctacaaaatcagttactactactccatatgagttatggactggaagacaacctgacttgagcatattaggaccctggggttgtgctgcctatacacatgattcctctcatgaatatggcaaattgggcccgagggaaagaaaagtatctttataagatactctgaaacctcaaagggttatgtgtttacaggtcagtaagacagtgggagtgtaactgagttttaatcactagatatcacattcttagaggatgagttccctaagaagggagagataggtcaagacctaaccttatttgagataatggatctagaagtacaaggatcacttcattcgagtgggagaattttagcagatgatagattagtttctcatcaaagaccttcatcatcatcatatgcaaatgaaagtaatccttctacatgtagtggaagtgaccaaatggatcttgttccaagtgggagcgagatggtcacagattttgttccaagtgggagcaggatgaatgatcttgatccgagtgggagcaacattgattcaaatgggaacaataatgaatcacagataagacgtggttctcgtaaaaatattcctcgccgacgatttgatgttgaagacggcaaactatttatgatgctcctataagaagaaaacgagcctaaaaatgtaaaagaggttctctcatgcccttctaaggataaatggacaaaagcaatggaagatgaattagaatctatgagagtcaacaaagttcgggaactagttgacctccccgaaggacgcaaagcaattgggagcaaatgggttctcaaaattaagctcaaggataatggcacagttgagagatataaggctcgattggtggtgaaagggtatacacagcagaaaggaatagactacgaagagactttctcgcctgatgtacgatttacctcagtttgcctggttctagctattattacaaacttggatcttgagttacatcagatggatataaagactgtctttctcaatggaaaactagatgaagaaatctatatggaacaacctgagtgtttcattgaaaaaggccacgaacaaaaggtttgtagacttttgaagtctatttatggcctcaaacaatcttcaaggcaatggtatatacgctttcagaactttcttgtatccaatggttttaccatgatggatgaagaccattgcgtgtataccaagagatcaagagacaagcttgtaattttaacattgtgtgtagatgacatacttatagctggaaatgataaggagtttataaccgatataaagtcatggttatcatctcaatttgagatgaaagatattggtgaagctgcatatattcttggagttaaatttcaagagatcgtctaaagaaactattctatctctcacaagagaattacattaggaaagttcttgaacgattcaatatgcaaaataatagccgagttgaaactcctatcagtaaaggccataccttgggaaatcagatgtcacgacccaaatctaaccatgtcgtgatggcgcctatcgtgttacaaggcaagcctattttccaaaatattactactaatttgattataagaatttaataaaatattaccaacattttaactcctcataaactaaatcaactctaaatataaataatataaaatacggaaacgagccccaaacaccagggtgttactaagtcatgagcgtcgaaatctatgaactaagatatataactgtctaactatccatacagtccaaaagaaatagatgataaaaggagtaacaaggtcctgcggacgttagcagctactttgcagtctccaaagataaccggcctgaactcaacaatcactgcactctaactcacctagatttgcacataaagtgaagggtgttgtatgagtacaactgactcagtagtaacagaagtaactaaggaactgagtagtagtgacgagctaagcagaacaatctaattatttatttccataattaattataaacaggggtaaacaggtaatttccataaatcaacaaatgcgacaaagaaattaacaggtaaatgcagcaacaacaaaagtaaatggaacctcacagcaatgtgactccatcactcagcactcgcactcggcactcaatacacacactcaataggtacatgcgctcactgggggtgtacagactccggaggggctcccaaagcccaagcgctaagcacggacaactcacgtgctacacgggcaactcacgtgccataatattaatctctggatccgtatggacaactcacgtgttatggtatcaatacctggatccacacggacaactcatgtgttgcacggacaactcacgtgctataatcaaatgtctcacaacaggccctcgacctcactcagtcatgtacctctctagcctcacaattctcaacaaaataaggggacacaacccacatcaagtatcacatcatatcagcaaaataatagagactgaggtaaacatgtgcaataatttgtatgactgagtgtttttaatgtgagcatgaataaagactaagcatggtttctaacatgaaggcagacaagttcaacaaaaaataaatacataaatacagataatggctattggcctcacggactggaccagtctcaatccctcgcggcgtgcacccacacgcctttcacgtagcgtgggtatcactttcaaacagtcacattatctcaatttctccgggtttataccctcaaagccagatttaaaactgttacttaccttaacaatgtaaaatcctgctccgagatgccctcgcctcttgactcggtctccaaaagctttgaatctatccataatcagaataatactatcaacatatgctaaagaattgaattccacaagaaaaattaaataaataagccaaaaatctgaaatatgctaaaacccggccccgagacctatatcttgaaacccgtaaaaaatggcagaattagaaaccttgttctctcccgagtctaaccatataaaattcgtcaaattctgactccgtttggccctgaaatccttatctcaaactctccaaaactcagctctaactccctcaattacaccctaaattcctaccaatttcatgactaaacagtgggaaatcattataagcacacgtaaataaacccaagtaacttacgtaagtgatatctcttgtttctcctttggaaaacactgccctaagctcaaaaaccggccaacaatggtgaagaaagggcaaaaattcgagaagttgggctaatatagtttctgccagggatctcgcacctgaggtccccttctcgcatctgcggtccaatggtcgcacctgcgacttccacttactcgaccaacctccgcatctgcggttattccctcgcacctgcgagctcgcaggtgcggccctcacttgtgcatctgcgctccagccccaatcgccaaaatctgcatctgtgacccaatctccgcatctgcgatgatcgcgcctgcggctccccatccgcaggtgcggaaaaacaccatcacaacaccagaaaacaaccctttaaacttcaaaaatccaatctgttaaccatcggaaacacacacggggccctcaggacctcaaccaataattctaacaagtcatatatcactacccgaacttagtcgaacctccagaacaccaaaaacaacactaaaacacccaatcaacctcggattcaagcctaagaactactaaacttccaaaattcgtcaacgacgccaaaacttatcaaaccacgtccgaatgacctcaaattttgtacacacgtcacaaatgacactatgaacctactccaacttctggaattccattcaaaccccgatacctaattttccactgccgaccaaaatcgccaaatttccaacttccgccaattcaagcctaattctacctcggacttccaaatatatattttgtacacatttctaagtctaaaatcaccaaacgaagctaaccgaaccataaaaatccaaatccgagttcgtttactcatgagtcaacttccaattgacttttctaacttagctttctatctaagagactaagtgtctcatgtcactccaaaactactccggacccaaacctaccaactcgataccactcaacacagctgaaaaacacataaagaagcaaaatgaggaaaatgaggctataactcttggaacaaccgcccgaatcgttacatcagatgtgtcctaagactcctgaagagatagaaaaattgagaggagttccttataggagcgcaatcggaagtctaatgtatgttatggtgtgcactagacttgatatctgtcaagcagttggcttggtaagtaaatatcaaattgaccctggtttagcacattggcaaacagtaaaaaggatcatgagatatctgaagggaattgttgattatgccctttttatcaaggtggcaaggatatgcgattagttggatacagtgatgctgatcatggaggagatctagacgagaggaagtctacctcaggatatgttttcttactcggtgatgatgccatatcatggagcagtaagaaacaatcatgtgtatcactatctatgatggaagccgaatatgtgcctctcgcattagcaacacaagaagctgtttggttgaaaaagttcttggagcacttgttggatatcactgaaaatactgaaccagtattagtctactttgacagtgaggctgcaatatcctctaccaaggacccaaagtttcattgtaaaatcgaaaatatagatatcaggtataactatgcgagatacatggttagacgcaaggtagtgaatgtgaagtatgtgtctacaaaaggtatgttagcagatccattaaccaatcctttgtctagagatgcatttgtgagacacactaggtctcaaggcttgagtagactctgacaaactttattttgttatttattttcccgtgttcccaaactgatgttctttgattatcaataaagttgatttacatacatacatatttttatcgttgaatgttatgtgcattctttatttttttttgataagtatgtcgggtagacaagaggttggccttctcacacaggcaaccgcctccttatcttaatgatgtgaggagatgagacatggttttaagcaaaattatcataacgataatctgagagctattcgcttaaaattataatgtcgcttaaacaatgacacaaggtcattagggtgaaaaggttcacctaacctactttgtgagccagatgtgagttaaaaatgatattgtagatcaaagaactcaaatttagatacttatatggtgtctaaatatcatctgtacaacattctttataagataaagacatacgctccttgggaaaagggacaaaatgttgtagcacatgtttcataccatgtgtgccaatgtcgaccaattgggttaagataagcccattctcaacttattgttgtgtgagacccagagcttttatgatatactcaagattttgtacccttagagactccgatcagatacttgagacttagtgtgatgttagctatcttagtgtgtttttaaaagaccatgaacacagattcggtctagcggagcatatctagaaaaacagtgatactaatgttaagggaatcgtgagatcattgatggaatctcatttgcaccaattataacttatgagttatgattgtgaatacaagaaataatgatatatagattttgagactatatcaaatgtgatttatatgatctagggtactgcatactttatgatctacttgcaggtttgcgctcgatgagaggctatgtactcctaacagatgtatagcacttagctctcacagtatgttggacgcacgatctacttccttgtatgaatgattgaggagatgagttgagaatatgtttctcagactagatgagcactcccattatgtgtgagtgagggatgtaggaaatatcgagtccactcattaggggttctctaagacccaatagggttattagttaaccctaatatttctatataagtacacttagcgtgtacacaaaataagactctaagcagtattttccacgcgctctttttctctcccaatccaaacgaggtttagatcgtgtaaattgggggttgttccaacacaccgtgacaaccatcgccaaccaataattccagcgtcggtttcgttcgttacttccgcttccgctacgcgaacaagtaaattctcgttttacaatttacgccgctatctatctaatgtgtttagattaacgtgttccttcagtcttggaattaacggattgaacaagaataaaagatcaatataaagaatttacctcctatacttgtaatatatattaaatctattgtaaataagaaatgttgatgagagattaacaagagacatgcatctcgtttaggttcaaatttcggcgaagttaaaaatattaggtaatttctttttatttgtctagattttagtggacagaattatttagtacctctctcgtggaacagttaaagtgtgcccaaattaatccgtacaccatgataattaaaaaataaacaatggagacttatgaagccattatgattaagaccgaatgagatcattccattgaatagataatcggtcctttcctctgagttgaactttacaaatatgaaataccctttaactaagcatgtacaagttaacatgtatctaagggcagtttgtgtgtggattaactattgtatgaaattttaaaaggttagtggagttttaactgcaagattaagaaaaaaattatgaagttaataatttcatttatgatttgccatcgtgaaggtaggggtgtacatggactgggttggtttgttttttattaaaacaaaatcaaaccaactatatcggtttggatcgattcggttttgtcggttttttcggattttcaattattatttttgctacatgaatattattctaatctcactttgttaaaattatacaattttaacaagtgaatatatgtttagtaaaatattgaaaaaattgacaaacatatgatttattaaaatattttaatggcaatttttttccagtaacacatgatagttattttcttagtcgtctaacaataattttcgttaatgtacgctttcaaggttaacacatgagcggatcccaaatatttcaatatattttaaataaaattcaatataaagtcttaaaaatataaatataaatattatatatttatatgtcgggttggttcgaatttttttactcaatatcaaaccaagcctaatcgaaatttttaattaatataatttgatatttgagttgtgcaatttttcgttcgatttgaacgttcttagtgaaagtatattaagtaatttgatttagaactacgataatgcatttgtcactcaaccagtgtataagagtgtttaaagtgatttctggaatttgtttaatatctaacttcatagtattatcgtaaaacttcgtgtattttttttcgcaattttataatatcgtatttgtcaatttttttattttactgaaacttatttcaagagtaaaatgaaagaagtcacttatccacgcgaggtataaacatttatgaaaatgtatcgtattgtattgtattgtattgtatcgtttaatgaatacaatgtttggatagattgaattatttgttgttgttaaataacattctaatgtttggtttgaccgtatcgtactgtactgtaactgataagtttactaaaatactctaaattgttttaaatatttaatttatcaagaattacacttaaaaattatttaagaaaatccatttctactaatttatcactaattatgtcttatatataaattaagtaattaaattcatgcaaattctatcgaaattagttgaacaagttaataatattaaaaataataataagtaattcaatcataataataaaagttttaaaaaaaatattaagtagactccattcggacaaaagtaaaacaaaaacctttacctgaagagtatggagaagcggcagaagaacaaaacgagtttttcacgtatgtaggtcatatttggaatgttgtctttgagaatttatataggttattagacttcacgtagagttctattatagaattatatgagaaagaaactttgctattatttaaaacaaaggtaaagggtaaaatagaattataaagtaataaatttggacataattagaaagaaaataaaaacaatctcatcccaccaaaaaaatgggattttttattattccggaataatgaatttaataatataatacaaccaattttaattaaacaattaaagtaaacattgttatggagaaaacaatacaatacgatacatatttgacgaactggttatatcgcagtaatggaacgcgtcttataaatcgcatttaccgacgtggaattgtgtagcgcgacgaaaaaggaggactgctcctttgaatgataggtgacaaccaaccgctgatctcatctacccgcttctcaactcgcaatcttcaccgttcgatttaatattacgtagttaactacaaattctcttcttattcttcttaaagctttcgtcatcactttattttcagtatctcacgtcactcactgagagctctgaactccagttccaaacgtcgtcgttttcatcttccttctcttcatcaatcatggcgctgaagtcgtttgttgaagttgaaccggaatctcacttccccctggagaacttaccttacggtgtattcaagcctgaaccgggttcagtacctcgacctggcgtagctataggagattacgtcttggacttatcggctcttagttccgccggtttatttgacggtcctttactcaaaaactccgattgtttcaatcaggtcggttttattttcattttcagtaatttctgaagattattagtaggggttctatttttcctctgtttgattgcacgtttagacaatttcctaccgttaagttcagttttttggtaatcttcgtcgatttttgtgctctgttttctcctattgttcggacgtaattgtataatttcctgacggattgaattatatccgttgaatagtgtactgaatattcaatcgatcaatatagtttaattatactagtttacttattgatcaatgctattaaataaagttagctatagttaccttttaaatgatttattatttacaccgttagtgcatataacttgaactcctttttgactactaagttcagttttagatagttttcattgatttatgagctccttttatgttattttcaactgttaagtcctgtcttagttttacgaaagttacatattttgtttgattttcttgcgagtgttatactgtgcaatgtgtatagttcccgttgctcttttcttgagttatgtcctaaaaagggaagaatgaatgaagaagaagacaaaatatctgggtgctatagtgatagcattccactagttggatttcatcaaattctatgttagccattattggcaatgcaataggaaatttcctaacgacactgttgagttgtctcacgtcggtgtgatttgagatacttggtcttcttatatggtcttgagcaatcctcacctcataagctagcttttggggttgagttaggcccaaggtccatttatcagacacaattacaggattcgagttatatacactggcaatttaattaattttttacaatatccgtgtaatttacctgttaaagcaggttacttgccattctttttaggttatcaatcaatgctagtattaaataaacttgtctaaggatctttcccccgcaaaggaggcgactgtgcacttttttgaaaggaagctttagcataagagaaagctagttcggggtcggtgaacaaaagaaggctagatcttcaatagagaaagagatagactgagagctcagctagaagaatctcacgattagaatgagttcttgcttcttaccttaggggttcccctggggcaagagaatacagctcttatcgaagactgcattaccaccggtcccctttaatcagaactgtgaaaaggagtgaaaatcgtcgggctaattataatatagggatagaaaaggaattggcaagggcaaggtccgatcggaaataggataaataattggaaaaagtccctctccgataataggacttgaaggctttaccttttaacccgacctaattgtacactttttatacaatcccatgcatagaacgtaaactcataatatttggcgagccactaagccttgtgtaattgacacactcggtactgttgatatttaatgttaatggcaaggttgaggactgtgaagtcataagctaacttctttgtatttgtagactaacttgaacaagtttgtgggattggggcgagctgcatggaaagaagctcgggcgacattgcaaaagttgttatcaggtatgcgcttctttttcatgtaaaggcctgcttggatggaggtagattgtatgtattacaaagtcaaaagcttaaatccttcgcatctgtttggatatacctagaaaacttggattggaatataaacttaaatcacattcttcttagtcccgttttggattcaatgaaactcgacaaatgttattaaacacataataaatttattaaattttagacctcatataaatttaaaagtctccgtccaaccttatcctggcaatatctgatataggatatcctgagacccattgagtctgtttgataaaagttgaagttggttattctgttttgtccttgtgcagccacagaaccaactctgcgtgacaatactgctttaaggcatatagctcttctgcctatggtacggatggtaattggatttttgacgtctgttagtggactggttttgtcttcattcttgtgttgtgttgttaatacttcaggacaaagttcaaatgcttctacctgtcaccattggagactacacagatttcttctcatcaatgcaccatgccaagaattgtgggactatttttcgtggccccgaaaatcctatcaaccttaattggtatgccgacaactcagacaccttacaaatgtcgtataaattaccttggacgatatttccagccattttcttttctcggggagggagggagagggagagagaaagagggggagggagaagaggagggggaggagggacatccttgtccttgtactttcgtttctatatgcttgctcatggaatctgatcacccttttcaggttccatcttcctattgcttaccatgggagagcatcatcaattgtcatttccggaacagatattgtgagacccaggtgaacagaaaagtagttttcccagtcctttctagaaatctgtatcagtttatttatgtgggagagaaattaggaagataactgtggagtgcttaagacatatttgacgagaatttttttgcattaatcatttaggccgtgacggatgtttgtgctttaatcactcctttgtcagggtcccaatgttgcagcacctaagtgaatagctacatcaatgatcttttaactgaccgttctgtggcatttaatttattggaatcttctaatttgattcttggtcgtgaagcatttccattgcagtggagagaattaggaagataaccgtggagtgcttaagacatatttgatgggaaattgtttgcattaatcatttaggttgtgacggatgtttttgatttaatcactcctttggcagggtctcaatgtcgcagcacctaagtgaatagctacatcaatgatcttttatcaggcccgctctgtggcatttaatttattggaatcttctaatttgattcttggtagtgaagcatttccactgcagcgttagacatggcacatggcgcttttttctccgttaaatgaatataaagtttggtactttataaattagatccaagtttgcactaatagtgcatgttatgttcatgccaattcacattttggtgtttgatgtgaatagattatgtgtgacctgaattctccaactattacaaataaatgctggcatctttttcctaattatgatttgaatgtcttccagaggacaagctcatccaactggtaattctgcgccatattttggaccttctagaaaattggatttgagttagaaatggtaagagtttatggctcatagtttggaaaatgcatagtcttatataaaatgcaagtgttctttctattgttggtcaaactttgacttatcttccttttccttgccgagttgtttgttaattccatttgtacactgtacttctttttctttaaggctgctgtagttggccctggtaatgaactaggaacaacggtggatgttaatgaggctgcagatcatatatttggacttgtcttgatgaatgattggagtggtatgcttaataatacttgactttttgaagttcttgtggcatgattctgtgctgataactgataagcaactattttaaacagcgagagatatccaggcatgggagtacgtgcctcttggtccctttcttggaaagagctttggtaagaaatccaattgactttattgcatgcatataactgcttgccatctgaaagtttctcatgtccttttctgctagtattctagaaatataaccgtaaggataatatcattttcctattttggtcttgcaggcacaaccatatctccttggattgtgacgttagatgccttagaaccctttgcatgtgaggccccaaagcaggtagtcttgacttctcaactcttaaaaccttgcgttcctctctagtgaaattcatattgatcagaactttttctcttctttcaattgcagaacccttctccattaacatatcttgtggagaagacatcaagaaactatgacatttccttggaggtatcttctgttctatgcttcccatgataggatttgatatgtctagtacttaattgacaatgatttattttcaatactaaggtaactagctaagactgcgtacatcagacccggtccttgttggatcccgtgcatagcgagagcttagtgcaccggttattttaattgaaaaagttggtggagtagatggaatcctcctacctagtgttgatttatcaaacaaagggaaaaaacaagagataatagtttgttgttgtgcttagtcaaatttcatggatcatctggataatgagtgtggattttttgtacaaggttctcattaaaccttctggacaagctgattcatgtgttgtgacaagaagcaacttcaaccacttgtaagtattttgcagcttgcacttacaatttcatggttcttcacttatcaagccaaaacatttggaatctatttcgtttttcaccagaatcatgatgtctattgctgttaaagctttcagcaggatagcggcttcaattaggttgatggtgaagataatggttcatgtaacagctaaattaatcacctgtgcctaatactccgccctgtccctcgaccaagctgacccccacctcccccaaaaaaaagaagcaaattgtccaagaacgtttagcatctaggttttgaggattctggttcttcaaatgctaaaatgttcaagggtaatcaagtgtagaaggagatgcaacaaacacacgcacatcaatctaaaggaaattttacttaatgaatttcttttttctccataataatgctgaatgattttcctttgatacagatattggacaattactcaacaactagcacaccatactatcaatggttgcaaccttaggcctggggacctgtttggaactggactatcagtggaccagtaagatttactactcagcagcatgatgcctctacaactcctcgctccaactttccttgttttattgacttgtcatcttgctattttactaaatatttgcttgtagttactatttactgatgttattatttgtccatttgtctccaggaaccagaatcctatggatgcttgcttgaattgacatggaatggacaaaaacctctgtctttaggtggaactacccgtacattcttagaagatggagatgaagtaactttctttggttattgccaggttgcttctggatgctcttttcctttgcccattttcggcttgtaccttgttggccgtagctgatggtgtacacactcaattacaagtgcttggaaagataagatgttagagattcttttccagggtctaaaaaacattggatgttagtttttcacctaaacgagtagagaaagaaaaataaaaagtagagctggaaactgccacattaagtggtggttctttattgtgtatttaaaattctttcaatcttcttttaggatctatgctccatactaattctgatttagagtaaaattttgaaaatctgcttagtgcaatgttggtttcacgtgagcacttgcattatattatggtttttcaaatttcctatctctaggttgatgtcgtcaactgttattgaccaccactgctgttttctcattctcatttctgagagaacctctcaatttttattttttttgttggtgctattcacttcctactttacttgaagagtgaattttatgacagtgttattatcatttgttgttattatctgaaagacgctttcaaatctagtgaatatggcaaatgtgccctattgaaattcttagagatgctattgtagcttaactgattcttgacaagactccttggaccttgtgttgaattccctcctccatgccgaagtgatgtattttgctatccttatctgtgatctcaacattatgatgagattgtttagtctgatactcgtcgatttgaaatttattatcagggcaatggatacaaagttggttttggaagatgctcgggaagattgtctcggctccacaatgagcatgaattactacattgtcctgcccatgagcaattgagaactgttgcctattgtatacaaattcctgtcttgatttcgcatcaaaattaggagtagaatcagaagaaattgtggcaaactcttggctaaatgtgagagcattgtgtattcttacattattttactgcaaaacaaataccaattcatagcgggtgtgctttaatgtagcataatcttgtcgcatatctatcacctttttctttcgtggttgctttatttgttcatttaaaaatcgtatctctatcagttatcgtattttaaaggatttttacctcctatatcaaacctttacatcttatttattataaataaataccttttataaaattaatattttatagctaccttttaggtttataactaattatttatttatggtcactttctactgttaagccattaaatacgttgtgaaatttttctctcatactttctattctctctctcttccaataacaccggtattgtatccacttttgttgaacctacattctctctccactatctctctcccaacccatatcttacttaggaatacaaccttcattagcaactgattcatctccactctcttcaattttcaaaatcatttgcccaaaaaagttgtggtaagtgttaaacttgttagcttttcgctggaagatgtattattctgtatatctgtactttttttagaaacaatccattgttatccttttacagaaaactcgaattttctctccaatgtctgattcaactccttacaacagggttatttaaggtataccgatcaaagtgctcaatttcgaagggtcatctttcgatttgataatcactcaagcggaacatgtatttgcaggttcaacagcaaatacagttgcggaaaagagaacaaaaatacgcaatgacatatcgaaacaagtccaatttgagaaatttccgaaagaatcaacactttcactgtttgtttttagatgtattttgatatatgtggatgtatttagatgacttttattgttgtacttatgaatgtgttatgtatttcaaataaatgtattcatctgtattttactgataaatagttattacagtgactttcactgtttgtttttagatgtatttagttgtatttagatgtatttacaagactttcactgttgtacttatggatatgttatgtattccaaatacatgtattcgtctaaaatgagtacatttttttgaaaatctacagaacgatagcaacataaaaaagagggattgaaaatctagagattgctatgttttgtggtctttttcgactgggaaatcttttcattaacatgaaatacagattctgcgtgttataatcgagttaattgagttatattaggagtctgtcgtgttaattgattcacttactgtcacgaccccaaatctaaattggccgtgatggcgcctatcgagatactaggctagccaatttactgagaataacataaaagatttccatttaatacataaattttgatatttcataataatttccgctttttaacatttcaaaacaataatagtggtcagacatataaacacagccctaacacctggagtcaactgtcataagcatttaagaagtaattcaacctgatactatttcattactaagaacaagtccgggaaatagataaatgacagaatagaaaggagaaaagagcaggcagcagacgccgagcagctacctccagatcccgaacaatgctccaatgagagagtgaatcagctatcgctcagtcccggcacctgaatctgcacacaaggtgcagggagtaacatgagtatgccaactcagtaagtaacaattataaactaaagacttgccctcgactcggcctcaaaccggatgaaagactactctgcaatgcttttgcccctcgactcggcctcaaaacgccttgaatctattcaaaaatagattcatattgtcaaaatatgctaaaggaacaaagaccacttataaataaccaatttacataaaaaatcccgaatttgtccaaacccgaccgctaggaccacgtctcggattccgataaaaatcacaaaatagaatccttgctctcacgagttcatacataccaaatacatcaaaatcggaccctaaatggcccctcaaatccccaatttatactctccaatttcaaaccctaaaccctaattttaaccacaaattttcctaaattccatgtctaatcaattaaatatcaccatagaaacgagttttaggtcaaagaatcttacctccacgaaattcccttgaattccctcttcaaattgctcccacaagctccaactcgaatgagaaattgatgaaataagccaaatattagcgaaggcatctatttatatgttctgcccagcgataccgcacctgtagcctttttcctcgcacctgcggtcccaggtgcgcacctgcggtttcttattaactcctcattttccgcaactgcgcctaatcagccgcacctgtgggctcgcaggttcggtaacatttccgcatctgcgatgaacctcaactagcccaaactccgcacctgcgatgaccattccgcacctgcggccacccgtctgcatttgcggaatcatagaacaaaatcacacaagcacaccctaatgccaaaaactcatccatcaatcatctgaactcatcccgaggcgctcgagacctcaaccaatggttccacaagtcatatatgatcacccgaacttagtcgaatcctcggaacacccaaaataacattaaaacaccaaatcgatccaaaattcaagtctaaggatttctaaactttcgaaattcgccaatgatgccgaaactaaccaaaccacttccgaatgacctgaaaatttgcacacacatcccaaatgactctacggacctgttccaacttttggaattccattccgacccgatagctaattttccactgccgactagaaaaatgccaaaagtccaatttcgccaattcaagcctaattctactcggacctccgaatcacattccggacacactcctaagtcccaaatcacttatcgaagctaccgaaccataaaatccacattccgaggttgtttacctaatagtcaacttccggttgacttttccgactataaaaccaacttaagagactaagtgtctcctttctcaccacaaccactccaaccctaaccaatcgatccaacacaacataattaagctaaacaacaaatgataaagaaaaaacagggaaaacggggctaatctcatggaaggaccggccgggtcgttacattcttcccctcttaaaccctggagtctcaaataggtgaaggtatctgctccgcatctctcgcctggtctcccaggtggcctcctccatcggctctctctccactgcaccttcattgaagctatatacttatacctcaatcttctgacctgacggcccaaaattgctactggctctacctcgtaagacatatctccctcagctgaattgtgctgaagtccaaaacatgagaccggtctccaacatacttccgaagcatggagacgtgaaataccagatgcacactcgacaagctaggtgacaaagcaagtctataagccacctctccaaccctctgaagcacctcaaaaggcccaatgaaccggggactcaacttgcctctcttcccggacctcataacacccttcatgggtgataccttcagcagaccttctccccaaccatgaaagatatatcccgaccttccggtccgcataactcttttctagactgcaccgtgcgaagccactcctgaatcaacttcatcttatctaaatgtatcctggaccaaatttgtacctaagagcctagcatcacaccactcaaaccaaccgacctgagatctacacttcctcccatataaagcctcgtacggagccatatgaatactcgcctaataactattattatatgcaaactccgcgagtggagaaactcgtcccatgaacccccaaaatcaatgacacaagcatgcaacatgtccaccagtatctgaataatgcgctcggactgcctgtccgtttgaggatgaaaagttgtgctcaactcaacctgggtacccaactctcccttcacgaccctccaaactgtgtgtgaactgagtacctctgtcagaaatgatagaaactggaacaccatgcaactggaccatctcccggatataaatctcggctaaccgctccgaagagtaagtagtaccaatatgaataaaagtgcgcggacttggtcagccggtccacaacaacccatatagaatcgaacctccttgaagtccgtgggagcccaactacaaagtccatggtgatccgctcccacttccactatggaatatccaacctctgaccacctagtctcttgtgctcatacttgacatgctgacagttgagacaccgagctacaaatccaacaatgtccttcttcatcctcctccaccaatagtgctatctcagatcctgatacatcttcgcagcactcggatagatggaataccgcaagctgtgggcctctgctagaatcaactcttgaagcccatccacattagatacacatatccgcccctgcacctcatcattcaatcatgcccgatagctacatctctggcatcacctcgttggaccctatcctgaagaatgagcaagtgtgggtcatcatactggcgtctctaatacagtcataaagagaagacctggaggctatacaagccaatacccggcggggctctgatagatccaatctcaccaactggccgctaagacttgaacatcaagtgctaatggtcgctctgctgcaggaagatatgctagactccccaaactctctgctctacgactcaaagcatcgaccactacattggcctgacctggatggtatagaataatgatatcatagtccttgagaagctccaaccatctcctctgacgcaaattcaaatacttctgcttaaacagatgctgcagactacattgatcagtaaaaacctaacaatgaaccccatacatataatggcgccaaatcttcaaggcatgaacaatgactgctagctcaagatcatgcaccggaaattcttctcatgagtcttcaattggtgcgaggcgtaggcaatcaccctaccctcctgcatcaaaacacacaaccaatgcctatcatcgaggcatcacaataacggtataagaacctgaagatgatggcaatactaacactggagctgaggtcaaagcagccttgagcttctgaaagatctcctcacactcgtccgaccacctgaatggagcacccttctgggtcaatttggtcaagggcgaagcaataaaagaaaacccctccacaaagcgacggtaataccccgccaaaccaagaaagctcttaatctctatagctgaggacggtctaggccaactttgtaccgcatctaccttcttcggatcaacctgaataccttcactggacaccacgtgcctaagaaagatattgagccaagccaaaactcacacttggagaactttgcataaagcttctccaacctcaatctttgcaatacaactctcaaatgctgagcatgctcctcctggatacgcgaatataccaaaatgtcatcaatgaacacaataccaaaggaatccaaatacggctgaaacacgttcatcaaatgcatgaatgtcgttggggcattggtcaacccaaaagacatcaccataaactcataatgaccataacgagtcctgaaagccgtcttgagaatatctaaatcccgaatcttcagctgatgatacccggattcaaatcaatcttagagatcaccctggctccctgaagctggtcaaacaaatcatgaatacgaggcaaaggatacttattcttgactgtaaccttgttcaactgactgtagtcaataacattctcatggaaccatctttcttcttcacaaacaacatcggtgcaccccaaggtgacacattaggcctaatgaacccatgatctaggagttcctgaagctgctttttcaattccttcaactctgctagcgccatacgatacggtggaatagaaataggctgagtgtccggcaccaaatcaatatcccttgcaggtggcatgcctggcaggtctgcaagaaacacgtccggaaaatcacggaccacaggaacagagtcaatagtgggattctcagcactgacatccctcacaaaagccaaataagacaaacatccttttttctaccataagctggggcttcagatatgaaaccaacatactaggcacatgctcaatagaacctctccactcaactttcgggaatcccggcatagctaaggtcacggtcttagcgtgacaatcaagaatagcataacacggagatagccaatccatgcccaatatcacatcaaagtcaaccatgctaagcaataataaatccactcgggtctccagaccccaatagatatcacacacgaccgaaacatgcggtccacaacaatagtatcgcccaccggggtcgacacatgaaaaatgtaactaaggactcacggggcatatccaaaaaatgggaaaaatatgatgaaacataggaatgcgtggatccaggatcaaataagaccgaggcatctcggtgatagactgaaacaatacctgtaatcactgcgtctgaggccatagcgtctggtctggttggaagtgcataaatacgagcctgacctccacctaatcgacctccccctctaggacggcttctcgctgctgaccccgcccctagctgcctgggcgggcggtgaagtgacccgacctgaagacgagggctggctcctctactaagatggacccccaagaagacgaggacattgactcctcatatgcccgaactccccacactcataacaatccctggtgtaggagatgaggactgaagggaacccctaacaccaagataaccactagaagaaccatgcatagaagaaccctgaactggtggtgctcgagatgaactctaagctggaagagcactgaatgaagagcggcccggatgagagctacggggaccgtgccccgatgatgcaccactataagatgggcgaactggctgaggaggcctaaatgagcggcctctgctatgctgaaactgacccctggagggagcattgctaaaactaccagatcctcgaggcctcttggcctccctctcctctcgctcctggaggcaaactgactcaatatccccgacaatatcaactacctgctcaaaattagcacatgatatcctctctctggtcatcagaacatggagctgataagtgaggccatccacgaacgtcctgatcctctctctccattaggaaccaactctgtggcatgacgggctagctctaaaaacctcatctcatactgcatcactatcaactcatcctgacgtaactgctcaaactgcttatgcagcttctctctgcgagactgtggaacatacttctctaaaaagagagtggaaaactgctgccaagtaaggggtgctgcaccaataggcctacgcttctcataagactcccaccaagtaaaagcaactcctgaaaaatggaaattagtaaacgagaccccactggtctccaatatccctgctatgcgaagaatcctctaacacttgtctaagaagccctgtgcatcctcgcctcagcaccactgatagtcggaggctgaagtctaccaatctctccaacctgcgctgctcatcgtcagccataactaggatcaacaaatcctaggctggtgcaaccggatgggctggaactgcccccggtgtctgaagtccttgaataacctgctcaggtgtacgggcaacaggagtctaggtgcctccccggcctgagaagtagcgtatgtagtagaaacagcgaccccctgtgcaagactggtgcacacggtcaaaatctgagccaaggtctcttgaagacctggaatcaccaataggcactaccggtgcctgagctggtcccactggtacatcagcggctggaacctgatctggaataactggagggtctataggtactgccccggctgatgcgcaggctgcaccactccctctactatggcctcgactgtggcctcagcctctcacgggcccaacggtgtctggtcaccctgatcggtagcgcgtgtcctcaccatctatgagagaatgaaacaacaaaattttagtttctagaatcaacagattcgcacgacaaaattcaagaatgtgagattttttctacggattctgcagcctctcgaagataagtacagacgtctccgtactgatccgcaagactctactaaacctgctcatgaccggagagtcctatgtaacctaggatctgataccaacttgtcacgaccccaaatctaaactggtcgtaatggcgcctatcgtgatcctagactagccaatttactgagaataacataaaggatttccatttaatacataaattccgatatttcataataattcccgctttttaacatttcaaaacaataaaagtggtcatacatctaaacacagccccaacacccggagtcaaccgtcatgagtatctaagaagtaatacaacctgatactatttcattactaagaacaagttcgggaaatagataaaatgacagaataggaaggataaaagggcaggctgcagatgccgagcagctacctctagatcccgaacaatgctccaaagagagagtgaatcagctatcgctcagtcccgacacctgaatatacagacaaggtgcgaggagtaatgtgagtacgccaactcagtaagtaaaaattataactaaatacttgagtgcagtgacgagcatttaataatcatgaaaatacatatagcaactaacaatgggaataaatacatgaagtcaaggatctacattctaagtatttttcataaaaactccagtttcccatttaaaatttcgtataaaatatttgttcaacaatttcattagaggcttagtataaagaagagtgaaaacgatagtttcaaaaaatatcagcccctcgagcacagtgtcactcgcaaataaagctctcaatcattcatgactgtactctcataagtcaatgctcgcactcagcattctcactcaacaggttccatatatataaccgatgcggcgtgtagctcgatctataatagtcgactgcgctcactgggggtgtacagactccggaggggcttctagagcccaagcgctatatcgttgcggcgtgcagcctgatccaatatctcgctgcagcgtgctgcccgatccaacatatttcgttgcggcatacaacccgatccatatatatatatatatatatataacgtagccgcgtgcagcccgatccataactatcctcacaatccggccctcggtctcactcagtcatcctcacaagccactcgggcatcttagtacaaatcaagagggctcagcccaaaatatctttcatttgtttaaaaatagagtggtgaacaggaataaacagtgaacgggtgtaaatcatgaatgaggatatattttctatcataatagtgtgaggacagtagtaaaaataccccctgagggttcaaacaggtcggcacaaggccccaaatatggcatacaacccaaaacatagcaaaaatcttttaaatacagaatatcatatgatttcaagtcaaacacgcagcttaatagtcgctaggggacggaccaagtcacaatccctattggtgcacgcccacacgcccgtcacctagcatgtgcgtcacctcatttatcaaaaataatacaaattgccggggtttcataccctcaggtctagatttacaatcgttacttacctcaaaccggatgaaagactactctgcgatgcttttgccatcgacttggccttaacacgccccgaatctattcaaaaacagattcataacatcaaaatatgctaaaggaacaaagccaactcgaatggacccacgtctcgtattactataaaaataacaaaactagaatcctttctatctcacgagttcatacataccaaatatatcaaaatcggaccccaaatggcccctcaaatccccaatttatactctccaatttcaaaccctaaacccccaattttaaccacaaatttccctaaatttcatgtttaatcagttaaatatcaccatagaaatgagttttaggtccaagaatcttaccttcacgaaattcccttgaattccctcttcaaatttctcccacagactccaacccgaatgagaaattgatgaaataagccaaaaattcgcgaaggcatttatttatatgttctgcctagcgataccgcacttgcgacctttttcctcgcacctgcggtcccaggtgcgcacttgtggtttctcattaacttctccttttccgcacctacgcccatcatctgcacctgcgggctcgcaggtgcggtgacttttccgcatctgcgatgaacctcaactagcccaaactccacacctgcgatgaccattccgcacctgcggtgaccgcacttgcagccacccatccgcatctgcggaatcacataacagaatcacactagcacactctaatgccaaaaactcatccgtcaatcatccgaattcatcccaaggccctcgagacctcaaccaatggtagccacaagtcgtatatgatcatcagaacttagtcgaatcctcggaacacccaaaataacattaaaacaccaaattgatccaaaattcaagcctaaggatttctaaactttcgaaatttgccaacgatgccgaactaaccaaaccatttatgaatgacctaaaaatttgcgcacacatcccaaatgactctatggacatgttccaactttcgaaattttatttcgacccagatagctaatttttcactgtcgactagaaaaacgccaaaagtccaatttcgccaattcaagcctatttctattcgggacctccgaatcatattccgaacacactcctaagtcccaaatcacctatcgaagctatccgaaccataaaagccacattccgaggtcgtttatctaatagtcaacttctggttgacttttccaactataaaaccaacttaagagactaagtgtcttctttctcaccacaaccactctgaacccgaaccaaccgacaccaacacaacataattgagctaaacaatacatgataaagcagaaacaggaaaacggggctaatctcacggaacgactggccgggtcgttacacttaccatttttaaacagctaaaaagaccatttttacgcagtttacgttattgtattcacaaatacaactcgcgaatacaaccgttgcttagctagactcccatatttcacgttgagttttgatactgtattcatgaatacagtagcttaaatacatcgaatacactctataacaactgaaaatataactataagaagtaatttagtaaatgatagctatagctagtaataaccactttacaatagtgatttgtaaaatttctctattttaatctaaggtaagccataaggaaataccaaatggtttgatccaacagtaaatttttgcatcggcgcctgatctgcgttataattgttggttgggtatttggaaatttatgttcaaccaaattgttgaacgtgaaaatacagcacgaagacttcggtttatacgggagatattcaaaaatagccatatttacaagtggtcattcaaaaatagtcacagtttcaaaagtaatcgaaatttagccactttttatgtaaagataaatttgtacgaaaacactattcaaaattcgaaaattacttatactggaactccggtataatagaagttttagtatattatattatactggagttccagtataatatactatacttccagcataatatactggagtttcatataatatactggtccagcataatatgctggaagttcatacacaggtactccaatctccagtatattatgatgaaacttttcgcgtgttggagttccagcataatatgctggaagttcatacacaggtactccaatctccagtgtattatgctgaaacttttcgcgtgttggagttccagcataatatactggaagttcatccgcaggtacaccgatctccagaatattatgctgaaacttttcgtgttacagcaaaatagtgactattttttattaattttacaaacgctggatattcttgaatgaccagtctgaaaactggctaacccgtgctatttgaacggtttatacacaaggtgtaagataggcgtctttacctttaacctaaatactcatgttctagtcttttccctccctagaaattagaaagagggaaaaagaaaaggataaatacgaaaagtattgtacacttagcaatgaaagtatagaattaaccttaagataatatgttaggtattatagagattagagagtggtctttgaattcaaatttgatggttcgatttatgtcggtttttctctaaaaagaaaccaaactaaataagtcaatttttcaaatattgaaatcaaaccaaactaaaccaaaccaaaccaattaagtcggtttttatcgattcggttttagtcgattttttgattttttttttttggttatttatcaattttttcttaaatatgagacatacataccaaatgcgtattccggcaattacattttcaatgtaacgctatcaaatcaattgctcttagagaaatctatcatttaccaagatatattgatgatacttgactcaaatagtgatgaataatttaagtactcaattaaaaatcgattatttttaacttgaaataaattcttgtacttaacaaaagaaactaccaatcaaactagaaatcaaagaattagattattataatagcaaagaactgttgggtttttaagccttgataagcttaaaatagggtgaatgggaaatggagggaaaaataaaatatttgagtaatatttgagattccctccttgattatcccatatcggaagaggaaaagattttgatgggtatataagcagttgctcttcttttagctcttaaagagttgagaagaaggcaagcctcgcgccgtcgtcgtcgtcgctcgctcggctcggcattaattttggaccaaatttatttgttaatattaaatattaacagaaatattattaaatatttatttaataataaaatattaatattaaaattaatatatacttcataaatgctcactaatttaaaattcgatatctactttctactatgactgattatccattttcgagaataaagaacctctaagataagaagtactccaccccatttaatagtccaaccttgcatggatttaaattaattaagtcaataaatttagactttctcgaaatctcgcgtaacagaaatttagtgaatcgggttgctcttttaattctataaagttcttctactcctagtcaaagatcctaaattagagccctatatacatacatacatacatacatacatatatacacatacatatatataggaccccttaaatattttagttgtgccctcgacacaaaaaggcaaacggaaaaagtggtattgttgggcgaaacatgcttaatcaaatatttgttgggtttttaagccttgataagcttaaaatagggtgaatgggaaatggagggaaaaataaaatatttgagtaatatttgagattccctccttgattatcccatatcggaagaggaaaagattttgatgggtatataagcagttgctcttcttttagctcttaaagagttgagaagaaggcaagcctcgcgtcgtcgtcgtcgctcgctcggctcggcttcggcttcggcttcggcttcggcttcggtcaaatgatcgattgattaattttggaccaaatttatttgttaatattaacagaaatattattaaatatttatttaataataaaatattaatattctatgggcgtttgcaaaaacagcctcttcagatttcagccacgactttggctataaatacaagcctattctctcagattttacatatactaatttctgagttcttctccttccttctgcatagtttttcttcaaagaaaagcaacagtaagtgtgatttgctatcgaactttgtgttcgctaaacactggggtttgaagtaccactacaccagtgtgtaattcgttctatcctgggaggaaataatccataacctgggtactaggagggattaaattccttaaggaaacactgtgaattcagtgggctcgaattggtgttcttatttcatttacattttgtttaagttatttattttattcataattgttgtacaaatacaggaaaataacaagcttaaggaatttaatttttttatttttctgtatttttgttatactaacaaagtttttggagagaaaaacctttgtgattttctgcttcattagagattaaaatctacgtgattttaacgttagtatcattcttttacagaaatgatgaatgacaacggaaacgaagctgttccgatggtaacttctactgcctcaactagccgaacgataccgccatcgttggcaccggctgagaaacccggaaaattttcgggattgatttcaagcgctggcaacaaaagatgttcttctatctgactactttaagtctacagaagttcatcaaggaggaggctcctgttttggctgatgaaactccagaaaatgaacgctttctcgttattgaggcgtggaagcattcagattttttatgcaagaattatattcttagcgggctggaggattctttgtataacgtctacagtggcgtagaaacgtcaaaagaactatggatagcgcttgaaaaaaaatataaaactgaagatgccgggttgaaaaagtttgttgctgcaaagtttttggactataaaatggtagatagcaagtctgttattacccaagtccaggaattgcaagtgattattcacgatctccttgctgaaggtataagtagagttaatactaatgttggtagtattaattttattatatttactaatagaattttcattgaaggtctcgtcatcaatgaagcattccaggtagcagcaatgattgagaagttgcctccgtgtggaaggatttcaaaaattatttgaaacacaagcgcaaggagatgtcccttgaagatctcattgttcggttgagaatcgaagaggacaataaagctgctgacaagagaggccgtgtaaattcaacaataatgggagcaaatattgttgaagataacaaaaagagaaagaaggcttctggtcctaaatacaacccaagcaagaagcggtttagtggaaattgttacaactgtgggaaaaccggacacaaatctacggagtgtcgtgctccgaagagagacaagaagaagggtcaagcaaacatggtcgaaaagcatgacaatgttgatgacttgtgtgccatgctttccgaatgtaactttattgacgatagataaagaatggtggattgattctggagccactcgccatgtttgtgcaattaaagaagcttttgctacgtatgctccagttggacccgatgagacgatttctatgggaaatgcttcaaaggccaagattgaaggatgtgggaagatatttctcaaaatgacttccggcaaagtggtaactttgaacaacgtccttcatgttcccgaaattaggaagaatttagtctctgctggacttcttgttaagaacggctttaaatgtgtacttgtatccgataaggttgtaataagtaagaacgagatgtttgtaggaaaaggttacctcaccgagggccttttcaagctaaatgtaatggttgttgaagtaataacaaatttcagcttcgtcttacttgcttgagtcaaatgaattatggcatgttcgtttgggtcatgtcaattataaaaccttgcggaaaatgattaatttggaagtattgcctaagtttgaatgcgacaaatcaaaatgtcaagtatgtgtggaatctaagtatgttaaacatccttataagtcagttgaaaggaattcaaatcctttagacttaattcacacagatatttgtgacatgaagtcaataccatctcgaggtggaaagaagtatttcataacttttattgacgatagtactcggtattgctatgtttacttacttaatagtaaagatgaagcaataaacgcattcaagcaatacaaaaatgaagttgaaacacaacttaacaagaaaattaaaatgataagaagtgataggggcggtgaatatgaatctccttttgaagaaacatgtttggaatatggaattattcatcaaacaacggccccttatacgccccaatctaatgggatagcggaaagaaagaatcgtacattaaaggagatgatgaacgcattgttgataagttctggtttaccacagaacttgtgggggaagccattcttacggctaatcgaatattaaatcgagtgccccatagcaaaacacaatctattccatatgaaaaatggaaaggaaagaagccaaacttgaattattttaaagtgtggggtgtttggcaaaagtgcaattcctaaacccaaaagggtaaaaataggaccgaaaccgttgattgtgttttcataggatatgtgactaatagtaaagcatatcgatttctggttcataaatcagaaaattccgacattcataataatatggttatagaatcaaataatgctgagttctttgaaaatatatatccatataaaaaggaatgtgagtcgattggtgaaggatctaaacgatctcgggaagaaacaaaagaaagtacatttaatcaggagaatccaaggcgtagtaaacgtcaaagaacgtctacttcatttggaccagattttgtgactttcttattggaaaatgagcctcgaacgtttaaagaagctatgtcttcttcggaatcattgttttggaaagaggcagtcaatagtgaaatagaatccatattaaataatcatacatgggaattggttgatcttcctcctggaaataaaccgttgggttctaaatggatctttaagaggaaaatgaaagatgatggcactattgacaaatttaaggcaatacttgtggttaaagggtatagacaacaagaaggtcttgactatttcgatacatattctccagttacaagaattacgtccatacgaacgttagtagcgttagctgcagtttatggtcttgaaattcatcaaatggatgttaagacggccttcttaaatggagagttggaggaagaaatctacatggaacaacctgaagggtttgtggttccaggtaaagaaaagaaggtatgtagacttgttaagtccctttacggactaaaacaagcacccaaacaatggcatgcgaaatttgaccaaacaatgttgtcaaatggttttaaaataaatgaatgtgataaatgtgtatacattaaaaattttccaaatcacatagtcattgtttgtttatatgtggatgatatgctgataatgagtaatgatattgccaacataaatgcgactaagcgcatgctagccggcaagtttgatatgaaagacttgggagttgctgatttaattctgggaattaaaatccataagacttctcaaggtctggcattgtcacaatctcattatataagacggtacttgaaaaattcaagcacttggtctttaaagttacaaagactccaattgacgtgaatcttgcattagcaaagaacaaaggccaaagcatatcacaattggattatgctcgtgtgttgggatgcttaatgtacatcatgaattgtacacgtccagatatagcttgtgctataagtaaattgagtcgatatacgagcaatccaggtcaatctcattggatggccatgaaacgagttttgggtacttagtacatacccaggactttgctttgcactacaataaatatcctgcagtcattgagggatattgttatgccaattggatcacaggatcaactgattccaagtccacaagtggatatgtattcactattggtggaggagcgatatcttggaagtcgtccaaacaaacttgtattgctcgctctacaatggaggctgagttcatagccttagataaagccggtgaagaagctgaatggctccggaatttcttggaagacattccattctggcccaaaccgttggcaccaatatgcatatattgcgatagtcaagcggcaattggaagggcagggagcgttatgtataacggtaaatcacgtcatatacgacgaagacataaaaccgttaggcaattactctctagaggaattatcacgattgactatgtaaatcaagtgataatgtgtcggatccacttacaaagggcttaactagagagatagttgagaaatcatcaaggggaatgggactatggccgagaacaagtcatagtggcggtaactctacctagaagactggagatcccaagatctaggttcaaggagatcaaacaaagtcataaatgacggttcaacattgtcaactaaaattttggtccattctcgtgatgagacaatgttcagtaacaaggataaagcattaagtctttttaatgatttctaaatttgataccgggtatatcaaatagtgcatctacgggatgacacgtttaggaatcacctatgtaagtgtgaagtgttagccgcttcaaggagaattgtgcaaggccagttctctatgcacttatgaaaccaggcggtgttcatggctgaaacgaacacaacaatgagaaccaaagacggttaagggttggttgtgtgacttgtggttgtctaggtatacccaaagttcgacggttcaaagatatcaaatctaccgattgagtgagtatatccgacataagttcactacggaaagttcaaagggaaacctacttatccagatgcaattaatccttgcttgcgaatcacacagtttttttttcatgcatacttccgtgatatagccattccccattcatgtgggggattgttaggtttttaagccttgataagcttaaaatagggtgaatgggaaatggagggaaaaataaaatatttgagtaatatttgagattccctccttgattatcccatatcggaagaggaaaagattttgatgggtatataagcagttgctcttcttttagctcttaaagagttgagaagaaggcaagcctcgcgccgtcgtcgtcgtcgctcgctcggctcggctcggctcggctcggcttcggcttcggcttcggatttggatttggtcaaatgatcgatcgattgattaattttggaccaaatttatttgttaatattaaatattaacagaaatattattaaatatttatttaataataaaatattaatattaaaattaatattaatattaaatccatttcaagtattcaattttcagttttctgttattgtaacagaaaattaactacccttcaattttccctctttattgttgagtaaatagccaattatgtcatggcatttattctatgggcgttttgcaaaaacagcctcttcagatttcagcccaactttggctataaatacaagcctattctctcagattttacatactaatttctgagttcttctccttccttctgcatagtttttcttcaaagaaagcaacagtaagtgtgatttgctatcgaactttgtgttcgctgaaacactggtgtttgaagtaccactacaccagtgtgtaattcgttctatcttgggaggaaataatccataaccttgggtactaggaggggattaaattccttaaggaaacactgtgaattcagtgggctcgaattggtgttcttatttcatttacatttatgtttaagttatttattttattcataattgttgtacaaatacaggaaaataacaagaacgagactaaaaaaataaatggctaattaatgtaccataaaattttacaaactttatataaaatatacatatatataggtgcaatataaatttaaatagctgctttgatagtcggtttggtttggttgttttttggtttttttaataaaactaaaactaagccaaatttgatcggtttttaaaatttaaaatcaaaaccaaaccaaacctaaaatttatcggtttttttgatcgatttggtttggttttcgattcggttcgatttttcgggtttttatgaacacccctgctatttttcaaaagaaaaagaaggaacaaaaaattgatactaatatagatgatttaattaaatatacccaacagacggtcttttgctttagtggaatttgttcaacaagaaagtggtgttatcttatggatgttttatgatgcaaagaaacctaaagattttaatggaaaaaagtgcatatattttttaagtttataggttttgaatttccgaacttataacttgttttagttactgaattcgtgatcaaatatttgtacagtcaaacctttctatataatagatttgtttgttttcgaaattttttccatattatatagcgaagtgctgttatagagaatatatggtataacataacataaaaattggttccgaaaaaacttgacttttacgaagtctggcacttttcttgtctgttttgtctttatgtggccggtctttctttccctttttctgatcgaaagatcttttttgacgcgctatcgctataaaggttacggcgcgcagcgtcgtgagaaaggggaatcgtcacttgcaccaagggttgaggttgaaaaagaaagcagcaagtgaagagataaggcctctcatttccattagggcagatgcattcccattgtaacggcgaagtattgttataaaagaataccgttatagaaagatctgactttatatattttataactttttttaatataaataaagtctagacaaaagctactgatttcgtccgtactcgtaactctgcccctgtatgtgaagatatagatggttgagttaggcttgaccaaaaaaaataaaaaaataaaaattgtgtgaagaagttgactatcaaaattctttattaagtaatagagattttgctttgcttgcctgcaaagagctcaatgtagttgacgacattaacacttggtggggctttaaagctttgtataacttaattattttttattttaatttttgtgaataaacaaattattaagtgatagaattaggctaccaacctgatagttaaccttccaatatttctttccaacttcaaatattttcctctttcaaattaatgattttactattttacccctacatttgtatgttaattactaccatttcttaaaagggctaaaataccctttcctctttttctctaatattagttgaatattataatttttccttttcatatgtatatatatatatatatatatatatatatattgcacatgactcgaaaaaaaaaatagaaatatttccgatcatagaagcaaaaactcgaaagcacatttaattagctagtggttggtacaatgtaataagaattagaatctaaaatcacattttgagttaatgttcattggatttaatttatatacatcggcagtatgaaatactatttacgctatatgctatcgggtgtattattatcttgtggtacgaagtaatctaccttatttttcaagtaacttaatgggcgtttggacataagaatagtaaaatttcgaaaaatatgaaatattttttttaaataaaaatgatatttgaaaattagagttgtgtttggacatgaatagaattttcggttatttttgaatttttgcgagtgatctgaatgattttttttttgttgagaaaacaccttttttgaagtttttcaaattttcgaaaaattccaaaattcatcctcaagtgaaagttaaaaattttatggccaaacactgatatcaaaaaaaaagaaaaattttcggaaaaaaaaaaaatcatggccaaacgggatctaattagtctcattttttatggacgatatacgtaattatattttaattgacgccataattataaaaaattcttttatattatcagtgtataaaaattaaaacccatttttatacgtaaataacatgcaaaacaaaaaagtgcttaatgagaaaaaaaaaaaaaaaaagaacgttaacgatcgtgagttttattaatagatcactaatgcatttaagcatctaattaattgttaaaagcctgaattaattaaaatttcggtttcttgttgaattaaaaaatctcaaggttataaatgtaatagtattagtagtaataataaagaaagtaattgaaaagggcatgtgaaccatgcaaaagcttctatataaaaccaaagatggtagcgtttcattttctcttcattccatctaatatatgatctttaccaatttttatttatttttcattattaaaaacataaagattatcaattttttcttcagcacattttttgaacacaataaaattgtgaagataaaaatgagcaatatattcttgtttttcttcttctttttctcgttttttgttcttgaaaatttggctatagagagagtttctatcgttgaatcaattactatgaatgaagatatgataaaaatggctggttatggcgaagaaaagctctctactgtttatattcaagggaaagttgtttgtgataatgattttggctgtaataataataataataatatcaaggatgagatttcagaatttgatcctcgaccagtcccaggtttgtgtttgtctctcttcaataatctttttattttattttatatttgtggtgtcggggctagcttacaggggcggaggtagaccttccccagcctcccctcgtcgcttctggcgaagctgcgagttcgtgagcaagtgaatgaaggagccatgttcctaaaagaaaatgaccctctttcttttcttttcttcccctatcccttcaaagcccttgtataggttgggcgccagtgctttactaatataataaaaagtcaggctcttctgctgagcgaagctgcgagcctacttaaatatagcttacgcttaccaagcctaatctacaaaaatagggctacagcaagcaaagcaagctttcccccttcgtttgttgtgggtcgcgcctcactgcaggctacttacgggttcggacgagcccagtagcttttgcttagcccctgtatttatatttgaaaatccatgaaatgtgtataattatttgattgcgaatctggtaaactaagacgtgatatgggttcgatgacaagttcagaacccacaaactttaaatcttgtctccgcctttgctggcttacatgcaactcgcctgattttacaggatacttgaaattgtttaccagatatctggtaattctgtccgccaaagtttggacaaatggaaaaaaatcgcgtgcctccggctagaatttgattataaattgtatatagtaatattatttgaaattgttttagcttagtacaaggacatgcataattatgttactatatatttgaagccaaactgaatatttatcaaatttatttttatgtgtatagtattagttatctagttttgaacattttaatttgcagataaataattaatagttgaaaattgaaacgtccgaagattaaattaggacagtttgtgttgttaattaaaccataggtagatctgtaacatcaataaaactcagaataattaatagttgttaattaattcagaacgtttctttgcatacaaataaccttcttttaataaagtccttaacagttattgtatcagagagatattgcatttattgaacctatgcttctaaaagtcaagtttaaaaagaaaaaaaaaaacagaatagagaaaaggtattattaagaaaaggcaggattgagtataaaattttgaaacttgtaggaggatctatataataagtcaacgttgctccgcatgattgagaatcacgaggtctcgggttcaaatggaatatcaatttccaatggaataatcactactgatcttatataaagggcaacccagtgcactaagctcccgctatgcgcgggatcaggggaagggccagactacaagggtctattgtacgcagccttaccctgcatttctgcaagatgctgtttccacgctcgaacccgtgacctcatggtcacatggcagcaactttaccggttacgccaaggctctccttcactactaatcatatataaaggacaacccggtgcactaagctcccgctatgcgcaaggtccggagaacagccggaccacaagggtctattgtacctagccttatcctgcatatctgcaagatgttgtttccacggctagaacccgtgacctcatggtcacacggcagcaactttacccattacgccaaggctccccttcactactaatcatatataaagagcagcctggtgcactaagctcccactatgcgggggtacggggaagggtcggacaacaagggtctattgtacgcagccttgccctgtatttctgtaagatgttatttccatggttcgaacccgtgatctcatggtcacacggcagcaatttcaccgttacgctaaggcttcccttcactgctaatcatatatatgacaacatatttcaggtgcatcagtggctgtgttctgtggatcaagtggaaaggcaagaaaatcatgggcaagaaacactacagatgaagatggagaattccttattgatcttccttctcatctccatgctattccaaacttggaaaaaacatgtctagttaaagtacttcatctgccaagaaacaccatttgtgaacattcttttagaggaaaacacaaaggactcgagcttacttctatcggtgatggcatccgtacttacacgacagatacaattcatctgacctctaaagtttcacaaaggtgcagaaagagagttgacaaagagcaacaagaaactgtaagcatcatttagggcaaaaaatgagcatgtccaacaactcattctgctggcgcttcagtcacaaacattgggttgttggattttagctcagaacatgctggtattagcccgcagttcatcttgtgattcctcccacgaaaagattatgtatgtgtgtgagtgagagagatatatagatacaagtttcttgagagagagagagatgtaaatacaagtttcttgtatgaacaatgtgtgacaggtacatgtatttccactcaggatatgagtagcctttcatatagtcatactagatgcacagaagttcgataaaatatataagcataattgtagtcactgcagaatcaataacttaaattgtggcgagttaatgtagcaaacattcacatggatccacaaaaactaaaatgcgagctagaagaagttgaggacgatatgatctttcgattgaacaacttgtcatacaaactatccaggagaaatgttcaaaagaaaccttgtctttttcgatgatatgatgctaactaaaaaactagatgaagtctccccgtctttcttctcagctccagaaatgatatattgagcaacatcagcacaacatttaagtttgtctgcttcttcatcaggtatctcaattgagaattcttgttcaaatgccatgacaagttccactctatctaagctgtctaggctcaagtccttctgaaaatcagcactcgcattaacctataaaagatttaggattgagctccactatttgactcatagtttgcaacaaaagatgtgttgagttgacactgtcgttaagaaagctagagaaaaacactgataacaaaaaaaaaaaaaaaatagatgactgtaccttggttgcatcaatcttgtcaaatttcttcacaaggttaagcactcgttcttttatctcatcctgattggtggcaccagaactgctgcaagtgcgtatttgcaaattgagaatatttaacgcattccgtctttcagcttgaaactgtacttgcaatgggatcctaaccctcacatacttcagaatagaggatctcaagctttgcatttgaacctacaataagttgacattttaggacgtgcaaaagcagtttgggagattagaacatgcaaaagaaagaaggctaagagatgtagcaggacctaaagagcaattccatttcataataaatgtactatcatcaagattaggcgtttattctcattgtttcctgtttcatatcgatgtattacgaaattcaccaagataagtttgtcaagtgtaggaagaatctgttaaatctaaatagccattgcacattttatccttcaattacaagtgtgtttaccctgctgagtctgagtaaaatagttgacaactgtaagtctatgacatgaaaaactgtcagcaagtttgcttaacatgtacgtgctataaacaaatttctacacaggagaatgtaatgtagctaaaagtacccggcttgacatactgatactcacatgaagtagtccatgcatcttataacaaggcttatttttaacagccaacactcacacgtctatggtattctaagacttaacatgcctattctccacaagtatatgatcatatgacgcggaagtgttactacctcttttgactggtatgccttgccttctggtatgagaagtttcctttgttgttagccctgaaaatatacttatcttacttgatccatgaaatgatgtccccgaaaacatcattgctttacatacgacaagaatgatcctaaccccgacaacccgtaatgtccaacagaaacttctcaatccccaactcattaaaattaagtcaaacttaccattgcatcagattaaaactacagaactagtcttagataaaagaaattaaactactggagcttattgcctgccgaataggataatgctaaaggaaacaagtgaaagtactactcaatccacaaccactcagttatgaagatatctatcagatttataccaacagccaaactccgaattcaaaagggcatcaaaattgcccagttatgctatcaaaatccatataaaagaaccaattcaaaatgttaattttcataaaacctattaaaactaaagaaccaaaatcaaaatgtaactttcacttctttttttaagtttataacctaaaaaaatgttaactttatgacaacctataaaccaaatcaccaaattcgaaatgttagctttcatagcacccattaaagattacaacttgaacaacttgaagtaccgactcacctagttttcaagtgataatagtaagagtaaatagtaaaagtccgtgttcttgtttggcagaatgctaaaagatatatatatatagaactgaagcagctgagaaatagcagaaaacttaccaattttagctttcttctaagatgttttctgattctttagggagtgtaattttaagatactcttctgtttgctttattgcctcaatgaacggaaatttgtaggggtggtggttctgggccggggatatggaacacatggcccgtgggagaaatacacaaataaccactctttggactgctatttaggaattaacccgtaattattttatcttgaaaatcttcatttcaagactttgtttcttgaaaaattaaactgaaaaactggaatttaggatacattggctaaattctaaatagaagccctctagaatagttacctggtttatttctaccatgatggctcttatgcagggcgaagtgcaggaatagctactttaagcccgctattcaaaatatattcgtaatatataatatatttaaagattagtcaattcacccaaacttcaggacttgtcttgaatttaaaaaatcaggacttagtgtcctggatttttgagctactaatttaaaattcttgactaagtgtcctgaatttctgaactattaatgtacaattcgggacataagattcgaatttctagatacaatttttgaactttaggacacgatatcctgaagtttgaattttgaagttctaggacttcaggactaagtatcctaaatttgaaaattcaggacttagtgttttgaatttttgagctgctaatttgaaattcaggacataagattctaacttatggacacaatattctaaagtttgaatttgaggtttaaactctagatgtcgtgtcctgaagtttgagtgaaattgactaatctttaaatacattgtaaactgtgaatatattttaaacatgtataaaaatggctacctggtgtcattttcaccccttatgcatagtacaaatggcgtgggatagccactttttaacatggtatttactttttatccagtgtttttaatgatgagcaaaaataaccactactctataaaaattaatatgaaaagacatttttaccctttttcatgagtgttgtgtaaatattaaggacatggtgtccttaatatttacacggcacacttgaatttaaggttaacatttacacagctcatatgaagttaaggacatgatatcctaaagtttaacaaagggtgcaaatacatgccactttgtccttaatatttacacatcattcatggagttaaggacactatatccttaatatttaccaacactcataaaattaaggacactatgtccttaacgtttacccacatgaagttaaggacaccatgtccttaacatttacactgtacatatgaagttaaggacatgaggtcctaaaatttaataacagaaggtgcaaatacaagttaaggacattatgtccttaacatttacactgcacacatgaagttaaggacgccatatccttaacatctacactgtatgtatgaagttaaggacatgatgtcctaaagtttaataacggaaagtgcaaatacaggacactttgtccttaatatttacacaccattcatgaagttaagaacaccatgtccttaatatttacacagcattcatgaagttaaggacaccatgtccttaatatttacacagcattcatgaagttaaggacactatgtccttattatttacacaacacccatgaagttaaggacaccatgtccttaatatttacacagcacctatgtcaaacacaggagtattttcgtttggacgggtaaaaaattattaagtactgactgaaaaaataaatacattttaaacagtaaccaaaaagtaaagacatctctaaataggagacgaaagccactaaacagaaaataagattgagacaaaacaacctcaaactaagacagaaatggacactaaaccacacgtttcatcctcgtccataaattttggaaccttctgtattttagcatttgtgttcatctccttttcctggggaaagttgccaaacttccttacataagattaagaaacaaataatttcttaaaagctaagctagcgtttggctataggttttcaaatttgtttttaaaaatttgatttggatgacgtttggtttgaagatgaaaatgtatttggacataagtttttaaaatatatttcacttttttttttgaaaaatatgaaacatgacttatatccataagttctcaaactatcataaatacccaacagtaccttttatcaataacattcataatattatcgcaaaccataatcctgaacataaataaatttggtacaaaattatcattcttataatgaactacataatatactatcagatgatcgagaagacgaaacaatatttttataaataataaatggtggactcttttataaaatacaaaattttatttcttaaagtgtttttattttattacctttataatcagaataaggtgtagagtgagaaacccaacctctctctaaaaaaacaaccaaatagatacctctcacgccaactccttcactgtcccaattactacataggacaaacaaagaatctattatccatggagattctcccttataatcaaattacgtggaaaaagaattttccatgaagtcctaaaaataaaaataaacgaaatcatcagagtcatttccattaattgatctaggagaggactactatatagtacgctttaacaaagaggaaaacatggtgaacacactgcaaaatggactatggttcatttttggacatttcctcttcatgcaacgttggaaaaccaaattttgtggcctccctcgcaaaacaaactttcactgctatctggattcgactctcccaacttcccatagaattttatgatagggaaatactaagaatagaggatgactattagaaacttaaggcaagaatttcttggattcaggagggagatgccaatataaatttttttcacactgtggcttctaacaaaaatcgcaggaaaaaaattacttacttcaaagatgatagaggtaattggataatgatcaaatggcaatccttcaacatacttcccaatacttccaaaatatgttcaacactaaccacactgaaacaaatttgtctagtatttaaaagatcatactattttcaataatatagaccttgcaactctagacagaaaattactatcattggaggtagtcaatgccatcttttcattcaaaccttttaaaactccagggtccgatggcgtacatctttttttctatcaaaaatattgggatatagtagggcattcagtaattgatctttgcttaaaaatatttcataaccaaacacttcccccatgaattaacaacagatataccagcctaattccaaaaattcctaatgccaacaatttaaaaaacttctgatcaattggcctttgtaacactatatacaagattattaccaaaatcattgtaaataggactacaaccattcattgataaaatcattagctcctttcaagctagctttattaaaggaagaagagcttgtgataatgctatgattatttaggaaatttgcaaccaattcaaaaaaatgaaaggtaataaagcaaatatgattttgaaattggaccttgaaaaagcttttgataggcttgaatgatttttcatctatcgtgccttcaatttttcattttcttccgaaaataactcaattaattatgagatgcatatgcactagccaaattgccgatcctagttaacggagctatcacaaaattcttcactccaaatagaagtattaagcaaggtgctccctttcactttatatagtcatcctctgcatgaaaatgctatcatgactcattcttcatcaagtggacacctgtttatgagatcccatacatctgagcagcaaagacttaggcatatcccatttattcttcactgatgatcttaccctgatggcaagggcaaattaaaaaattacaaaatcattgacaaatgcctaaaactgttctgtaacctatcaggtcaagctatcaatcttcaaaaatcaaaaatcatattctccaaaaactgcacgcttgaaacatctaactacattgctaatggcttcaacatcaagattaaccactcttatggaaaatacttaggtttccctattcttgatagaaatcctaaaggctctgactactaattcatcatagataaaatgtgtgataggttgtcaacttggaaaagaaagttcttagacatagccggtagaaccacgctaacgatagccacaaattcatccctaatcatgcaattcaatacacaatactcccaaccataattcaaaaacaaatagatcaaattcagaaaaatttcatctggggaactactaataaaaagaaaaaattgcatctcattagttgggataccattacaatgcctaaacaattaggagggcttggcattaaaaagctagttctaagaacattgcgcttctaagtggactaacttggcggatcctaaccaaccctatggcaccatgggctaatattcttataaaaaatatggttaaaaaggatcaaaaaccctttgtttatttgaaaaagtattctcaaagtagatctgtcaaaatgggcagggccgtgctagcccatcctagtccatgtgggctttttcaattgacgggctggggtaggctagcctaccattttgatgggccttataatggtcagcccatcctagctctatgtgggttgcaggtccataggggcggcccatcattttttaaaacataattttgtatttttgtaagttctaatctaaaaaaagataaatatttaaaagttaaaaaaatcttattggagaaatttcacaaaacttaataacatttatattgttccaatatatacaatgaatactaaaaaagtaaaagacgagactatatttcattcactaaaagtcaaaactcaaaacaaaatattcaaaagaacatccatgacgcttatgagatatctaatacacacatcatattcatcaaacacatttgaatccgcttgtgagaaggttggcttaacatctttattttcatctacatttacaattcgcatgcaatattaattagttaaatattatgaataattaaaattttaaaactaattaatattttaagactttgatcttttaatatgatgagcttaataaacattaagccttggatactctttttgttattttttgtgtcatatactttttatattatatatatttttaatacgtatttttattaggtccacgggccggcccagcccaaccttggtcaagcctcacaggccacgggtttactcaggccgggcttaaaagtctcgtttttaattgggctccaaaaatttcagcctagcccaaccctgctaaatcacgggctgagctagcccaacaggccaagcccatattgacggctctacctcaaaggatgggacacatgctctaaagggattctctggctccctagccaatactcaaacctcaatatatgggatactaactggatccccaactctcccgagctgagaaacgttattgaaggaccccttcaaaatgaagaattcaatattaagatcaaggatatccttcacaaaggtaattggaacttaacaaaaacctcttttgaattacccacttccattattaataatataaacactatccctcaaccccttaaacaaggtaataatgacaattctatttggagcttaaacaacaataaggacttcaactggatatggaagttacattgccccaataaaatcaaattctttttgtggcaatgtctccacagtaaaatctcttgtcgccaatacctctaccacataagtttaaatattgatcccctatgcactatttgccgtaaggatgtggaagacattacccagattttcttatactgccctaatgttagaggtatttgaattctcttaaaatcaacaccaacaagattactggctctaatcattggtcattaatctaagggacttaacccccacattaacgttgactaatattgtatgagatgtcttactcccattccttttatggggcatttggatttctagaaacagaaacaactataataatactaatttaccaaccttactaaataacataatgagacaagcacaagaattccttcatctaaactccctaataaatcaatttgtcacaacatttccatcaacataaaatggcagcggcgccaaatctttctatggattgcttctttcgcctcgttcgccgtcaaagtgcctatggtaccagttcatatttggttacccgaagctcatgtagaggcacctacgggcaggaattgctttaaaattgagaacctacgggtttttaagattttcaatgctccacaccaaaactggtataagctaaatactgatggagaatacaagaaaagtaacaaaaaaacaggaacaggaggagtgttcagtcacacagggagctggatcgtgggcttccaaaaagaaactgcttcgatctctcccctttatgctgaattgcaggcaatatatgaggggcttcaagttgccgtaaaattcaaccttctccggcttgagcttgaaactgattcaacagaggccatcaatgcaatacttcatgatcacatagtctttttctaacattgtttatgcatgcagatcattaatgcaccagctgaaggaccccctgcttcgacataatttccgtcaaggcaaccaagtggcgcatctacttgccaaggacgccaccagcaaaagttttacgcaactccgtccggataggccaaaactccatgcaactccaccactttttgtgaaccaatagatgactaaggaacaagatggagaatgtctttttgaaaaaactttatctatttcggcttgtaatatgctaaggacatatcgcttgtgatattccaccaatgagtgaagaattttcacctacttgtaacaagctaaatgacttcttgttaatataatatatatccttttattatcaaaaaaaagaagaaatctttattttattatctttattctttttaatttactaatcaaatcatcttaatttaagtgcctataaaccatatatataacttcaatttgtaactttttatgaataaataatattttaaccctaataaattatatagatcgtttaagttttgatacacccatagtttttttaacattattaatcattaggattatttaattaaattaccttctatacctcctcaaattatccttttatcttttctctaggtaactttttagatcatctatgggaacaaggatatattcttttttaaaaaattaatgtcttcttgatgttttaaaatgacatgtgaactagtgagtgtaataacaaagttacttaccgcaaaatattatgctgagataaataagattttttatctttaattagaggtctcgttcaattttttttttaaaaaaatcttgctaagaaacgttttcccctttaatgaactttatacgaagatatagaataccgtgtgaaaaattcaaaaaacaaaaaagccacgtactcctaatttttttggaaaaaagaaaaagtttactccttatttgagacggtgggggattaaaataacaaagcactataactaacccggaacaataaaacaaccaacaaactttcccaaatggacacacaatggagggacaaaaaactatatccagcattaggcattttcaccattctttctcttttgtacttgaacttcaacgacaaccttaatttttccttcccacaaatctttctaaggcaaacaaagatgggttttgttggagttaataaaatcaatttgtgatcaagaatgaggacccaaagactcattctttaacatttcaagaattgtatattaatgggtggaattcttattggttaatggaagaaagtgtgtgggaatcttcaaggtatagagtctctgagatgttgagaagaggtgctgaaatgggtttgagtgtttgtaggacttggcttttagtgatggtgatgggcccaatgatcttcagctcctacctggtgtcttcaatgaaagagtgtttaaggtaattcactactattttgttaaaagttttcatctttattccttttcttttaattaaagatcaatagtggttccctgattattcacttgacttgtcttttagttgttttgttaacaagtataaggcttattgaaggacttgtagttaaaaagaaatatggcggtctggtgcagtaagctgccctatgcgcgaggtgcggggaaggaccggatcacaaggtgtctattgatagtagctttaccttgcatttctgcaagaggccgttttcacggctcgaaaccattacctaactttaccagttacgccaaggttacctttcacaagtacttgtagtaacttgtcaaatatttttagaagctgtttcttaatccaccaaagtgagaatcatattcaagtttctaattttactgtggcttttactgtgttatagtgctgtagagtgggatgttgatttgttattcttaaaacagagatggttttagtgagaataaaaggtaaagtttgagtctttataataaggtagggatatatagttaaatactatgctgcacattttgtagtatttctgaattgtaggaatgacagcacaggtatagcgtaagggtgttaaacgggccgggtcagcccgtttccggaccagcccagacaggttgaaaccggacccggcccagaccggtacatagggggccgagtgggttgggttaatggggtaacgggttggtccgttcacctttgttcaaccggttaaccggactggtcaaacccggtcaacgcgattcactgtagaaccggttagccggtccggatcggaccggttaacggttagttgtttcaaattttttttttttaatggattgttaccgttggcaacggtcagctgggccaaggagccgttgcccaacggttgttttgcacagatagccttttttgggccatttttttttaaaattaacactttttgtaattactaatttacccctttgaaaaactataaatacaccccccctctacttcatttcttcactcatctctcatttctcaagctcatattctcaattcaagttaaatcatgccccataattctagagtgcgctcatatgtttgggaacactttgaggtggtagaagaaaatgaagtagtttacaaagtaaagtgctaggactgcggtcgaatcttaaatcttcgtccaaagtgcacgggcacaggctgtttaaggaggcatatgaagagttgtcttgagcgttctccagaaattcgtatttaagattttaagttgatttgagacaatttgtgttattttaatattattagacgaattatgcttaatgttttagtttgttagattaatttgaattattattaatttattatgcaatgataagtgcaagtttgaactttaatttgaagtattaaatgtaaactttaatttgcaagtttgaacttgtaaattataaatgcaattcttttccatcttcattgtattctattatcttaaaatttaaattcttaatgaaatattcaaatataagaattttaaagtctttgcatcctttattcaaacactatttttataagattgttttttggttatatttttacaattgttatgcaaaatacaaaaataaatataattaaacggtacctctgcgccctgcctgcccttggacccgtaacccttacggttcatttttttacccggatggacccggacctgttaagcacagtaaatcctaacccgtaaccggcccggttcggtacccggactgtttcaatttttccctacccggcccggcccgccctccgttaaatacccttagtatagcatcaatgatattggcggatcgtggaattattgagtgggaacagtcgtgcaatatctgcataatcattggcatgctgaaaaccataatttaaaccaaaaggatatgcagatacattgaaggactcaactttttagtgtttaacacaatgaacatcagctaaagattactggaatggcttcgaatactttagattattacatctagcaatacgaatagctaacacatagtattctgcaacgatagtagcaatacaaaataggacatcaacagtcatgagtactgagtaccgactgctattctgaagatccaagcaatttagttttctgtagatagtggattgttttgtggatggcagaaatacaacttttatgcagtatttgttcaaactccattacattcaatctttgttaaataatcaatccaatgccataagaacgctgcagaaagtagcaacagaaacaacagactagtagaccaccactagaaaaagcggacattatagtgtagcatttgcaatttctaacgattatcttgccgctgaatctgcaagcatatatccttagaattctgttagtcttagtggactattacaaattattgtgcatggcttttcttagtgatgtaattttaggccatatttacaaatccaatcctagtacaagaaatcgccctccgtttttcgtgctttgatatagtctaattatcctatcaatttcagggattggattatgttattgttgaggcaaggaagcataacattagattaatcctcagtcttgtaaataatttaaatgcttatggtggcactgctcaatatgtgaggtgggcgcaagaagctggtaccaatgtgtcttcatcaggtgatgcattctttaccaacccaacagtcaaagcgtactacaagtcttttgtcaaggtatgttcaaattgagcattattattccagtcaataatgtgaatccaatataccttggaaatgcttttttttttaattcctggcaaccagctctctttccttttcttatactctccgtttgtcagaatcttttgttcacttagaaggttcgacactatgtgcaagcatctaattggtattataaacagtttgcagcatctaactagtttaagatctgttttaggccttcaatagtcttgatccgctctaaattgacatgtatcttctgaatctcctgaggagttgcaccaatatcatgtcttagatgcacgtttaaattttaattattgctgcatatatcagtataggatccagagaagtacatgtataacctgaaatgtatgaggctcaagtttcatattattgcttttttcttactacttccaactaagaggcaagatccaagaaatgagatcattgtgccattcttactatatcctcagttttctccttgagaaaatgctagtagctattgttctttgttccagtaaagttgtactgatcaaagcaaagaggacatgattttggaaacatagtgtactagtcattgtttggtttacctattctaattactagggaaaaagtttgaaattgttctggaggggcgtcataaaagcacttcgcgatgaaaacttcagcaacttttgatgcatttccacgtccaacttctgatagttcttgtatgctattgagattgtactaaaattatctccaatttatactaacctccaaaacatgtctttcttagttaagctactcctttctacatacttgaatgtgatcaaatgagcactttataattctttactcttttttgggcacgacaggctgttgtgacaagaaaaaactccataagtggagttaaatattcagaagaaccagccatatttgcgtgggaactcataaatgaacctcgttgtgaatccagttcatcagctgctgctcttcaggtgagtttttttggattatacagattgttagtaagattttcccctcaatgacacaggaaaacagaaaatagaagcaagagcgaataacatgctcttatcttaggtggaacaatcttgtgtagtaaattggttttccttattcaaggaaaataaagcatctggtatagattcactcatcatggtgcatctagtaccttattatctttagcttgaacggtgatttcgtggacaggcgtggatcgttgagatggctggatttgtcaaaaatctggatcagaagcatcttgtgactattggactcgagggcttctatggtgtggaaaaaactggaagctttggagtgaaccccgggaaatgggctgcatcacttggagtggacttcattgagaactcggcaattaataacatcgattttacttccgttcatgcttacccccatagttggttagtcaaagcagaatatatttattccaaaccagatacatcgtcacatcttctcatgcagcgtaaacagaaatacttatgtgtttatcactatttccttattgattctgttaaaccatgttggcgttgcaggatccaaggtataaattcagacgcgaaagtagattttctatctcattgggttgattctcacattagtgaagctgaaaggatccttaagaagcctgttcttttcacagaagtcggatttccttcaagtacgcaaaaggaaggattacatgacagaaatatttatctgaaaatagtttatgacaagatttatgagtcagcaaagaagaagaaagctggtgctggagccttagtttggcagttgttggtggaaggaatggagcgatatggtgacaagttctcgtttatagcgtggaagcatccctctacgtataaactgatagtagagcaatcttgcaggctactcaatacatcttctcaaggcgtctcacatagaaaactcaatcgaaaagatcattgtttggctaatgcatcttaaaaatgatagttgattcatcttccttgggagacggacaaacgaatgatgaaagttacctctagaaatagccagtcttgaatgttttgttctgacattgatcaaaggtatgtaaaagaagcaactctgagaagtgttagctggagggagtgcaaacaatcactcattttatcaggtacataaactcaggtttctgttgatgtataatatatctcgtttgtacatattacaatagttctcactactcttttgttttatagtgccgggtctagttattgctattgttttcatctattttctggcttttatgttgctgttattattcctttggtttctgttgatggtaaaggatatattgtctcttctcgttttcttgagccgagggtcttccggaaatagcctctcttccctcggggtggggtaaggtctgcgtacacactaccctctccagaccccactagtgagattttactggatcgttattgttgttgtacatattacaatagcaaaagcatgaaagtggttaattccttttcaattgaaataataagtgattatttctgtagtagtaccagccatttgtcatcaattctgtacatttggcacttaatgttctctgttacatgacatagggtagggagcgcttctccctttagcgggctatacaccttatacaacgcgaatctggaatagtaattcagatgcgcgacgcataagccaaaaaaaagaaaaaactgcaggtggtgaagaggtcttcttataaagagtagtagaactcatagtttagcctagtataagttaatagttaatactatttatcaattgataatgtcttaccaaattcattgtgttagagcaaatatatgcataataaacataacgcactgaactgtgtacaacatcataggtttacccgtaaaacggtacagttgaatttatacgtgatttatagacaagcgaatcgatctgatcccataataataaataaattgaacaagaatgtaagacttagcgttgaaatcgagatgagacagcaaagatcttggttccctataatggttgttgaactcactatttatagctgcatctagggaacaaggtcctagggtcaagcccctcttaaatgacaattatggaggccattgaagaatgtgtacggcaagctatgaatgtcatattctctgtaacggcctatgcacttaatgctatagaatattccccattaactgtcaccggatgataggtatttatttgtttttatgagcaacattccctccggagataaccgagattgctgcttctggacttgattttcacctgtctcgcttttcatctgtctttgattctacgtgtcactctattatatgagcatttaatatgaaccgattttaccctttataataagagtaatatgaattaatattgatttggcaaagataatatctacttctgacatataatctcctctatttgttcttataaaatatagaaggatccttaaacggaggattagagctagctagacatgcaagtacaattttcccaagcaaaatttgagagatttatgtgccaatagaaaatatagagaaaattttacaatttacgttcttattttgtacaatattggttttgatgagcttaaatgaaatgatatgggatttctttctcgttctcgctgctgcgctcctttcttattctttttttctcactctgaagtgagtgaagtcaagctagcctcagcaaatcggacataagtaataaacctaaatccccgtccttttagaaagaggatagcgattcttgcaatcaaaaatgatgaatatgaagtctgggaggctgcagatactatgaatcctccgacacctaatcgggttgccttcctaggtctcgccggtgttgcctgtaggtcgtaatgtgccttgagaaaagaaatgcaataccggttgtcatcacatacttgacacaaatccgtcatttttatgcttcaacttaaacgggacaaaagtaactatctgacgcactagggagttatagtagatactactattagaccaatgttaatgtttattaggataggttttcttttattacattcttggggatgcgatctttttacaaaccctgtgtaaatgtgtaatattttgtgcatctacatgttctttttcattttctcctattagctaaccaggggcagagctgagtttcaataacgggttcgaccgaacccagtagctttagtgcaaattgtatatttgtcttataaaatctattgaatagatacaatttttttagaatccaataacataaaaaagctagaatcccgaacccccagccaacactctatagaattggtctttaaaacagcattaatttccatttactgcgccaaacaattgttattggccctaatgctttgcctcgtcagtatcaataaataatgcttcataaatgatttcaacattttaattggatactcttgtcaccatatacaatttgaataaaaaagtttgagtctataaagatttctgtttattttctgtttttctgtgttattttcaccattttctttttgtaaaaaaggctattatattttcacaaccaaattacttgtaacgtaattacaagtaaattatataataaacatcaaatagtaacttaataaaaacgataattgatcatctataatatataaaagtatactgatagcggaaagaaattatataccgttactgtgaataacttaaatcctttattgtgtagacagaaaaagaataataaagagttaatttctcaaatggtctaacttcggttttcgattaatcccattaatttcgatacccacattgaatcccgattaactttgttttcgtgccaaaaaatccccaaacgttccttaccaaaagtgattccataccaaaagaaagtcaaattaaaaaaaaaaaaaaaaggacaaatgctgaggtggaacaatgagtatgagtgcctctatagttttccgaagaaggagcttttgcatctatactcgttttttgggtcacattttaacttatatccgctttgcaaaaaaattgcaagcgtacccacttttggcataaattcggcttacgggcctgaagtagcaaagacaatcacacaaaacttcagtattctagcttttcaacaactcagcagagtgctgaagttatttagttcatttgtaaaacttcaactctaaataagctgaagttttatcctggattaattagttttgtcataactctttttcaataactcatcagaagatgctgaagttatttagttcatttgtaaaaacttcagcactaaataagctgaagttttgtcctgaattaattagttttgtcataaagctttttcaaaaacttcaggagaagatgctgaagttatttagttcatttttaaaaacttcagcagaagtgctgaagttatttagttcatttgtaaaaatttcagcactaaataagctgaagttttgtcctgaattaattagttttgtcataatcctttttcaaaaacttcaagagaagatgctgaagttatttagttcatttgtaaaaacttcagccttaaataagctgaagttttgtcctgaattaattagttttgtcataaagttttttcaaaaacttcaggagaagatgctgaagttatttagttcatttttaaaaacttcagcagaagtgctgaagttatttagttcatttgtaaaaatttcagcactaaataagctgaagttttgtcctgaattaattagttttgtcataatcctttttcaaaaacttcaagagaagatgctgaagttatttagttcatttgtaaaaacttcagcattaaataagctgaagttttgtcctggattaattagttttgcaataaagctttttcaaaaacttcagcaaaagtgctgaagttatttagttcatttataaaagcttcagcactaaataagctaaagttttgcacatgtaagagtaagaaagagtcgctcgaagttgtaaaaattagggtataagttaaataattttaaaaaataggtatagattaaatagggacaaccaaataagacgtcccgttcaatttttatcccgaagaaagataaaatacagcctacgtgcacattttggagcgataaaagagccacgcaatctactgaaatacccacattttaggttttattaacagaaatgcccttcgtcgtccctaagtccttcacttattatattatatagttaaagaatgtaatcttggtaaggttaaaaaataatcacagcagatagtaacgatttattgtacgaagaaatattgcaattaatattataacacctaaatactttaatcctatcagctggattactaataaaaacaaactctttaacaatgtcatataaattatcaatattacggtacgaaatagaagaaattgtgcataaaaagcagtttatcgtaacaaattgtataagcgcaaataatttagataagttaaaatattatttgatagtttatttatggtttgtgttgtaaggtcaacagttaataaaatgttactacatttattgctaaataaattatattatgcctaatcgttcaataaaccatccaaagagtcagtgagtatatatcttatattaacatataatagataacttcgtttagtaccacatatcatcaagagaaactaaaaatatccataaataatttgtatagtctagtacatcaatagtaatttctgaaaatagtggagcaagaagaacaacaaataataaaaataaaagaaattgagagattttggattacctaacaggtccagaggtaatatatatatatacacacacacgcgcgcacacacacatatatatattacaaagtttttattttattttatatatatgtggaaagaggagggctggagaattggagattagagcttttttcgaagaagtcttaatagaatctagtacttctaaccatgtctgaaaaatactatttgtctttccatgtataattacataatacttaaatcttttttcttggtttttatcggtaaaatattggcataaagcgtttgttgctgctataaaatatttggtgtcttttttattatatgatatccataaattatctattaaacatatatatatatatatatatatatatatatatatatatatatatatatatatatatatatatatatatatatgttgctaaagcagccataacttgttttaattaattgcagggaagagcgtgatagagcagatggatattgttgataaggtgagttctgattttagggtggttttagttaaatcaaactggggtatttgcatctatacttgctttttggatcacgttttaacttatacctgctttgaaaaaaaaagttacagacgtatccacttttcgcctaaaattcaggcatacgggcctgaagtagcaaaggcaataacgtaaaacttcagcattctagtagacggctaaacttaagcattctactagctgaagttttgttctctatttgttgaacttcaacatgttttagctgaagttttgtcctgtattcaatagatttgtcgtaaagcttttcaaaaactttagcagaagatgctgaagttatttagtttatattgtaaaaacttcagcactaaataagctgaagttttgtcctggattcattagttttgtcataaagctttttaaaaaaactttagtagaagatgctggagttatttagttcatttgtaaaaccgtcagcactaaataagctgaagttcttgtcctacagtcgtactagctgaagttttgttctctatttgctgaacttcagcatgttttagctgaagtttttggcataaacttagtattggttgaagtttttgtttgtaattgctgaacttaatcattctactatctgaagttttgctctatatttgctgaagttataagacttgaagcgagctggtaattggcacttataatgatagttatggtgcctctaattggattaaatggatatcttcacatgaaatacgttaatgattttggtgctgatgctaaggttagctccaaacgtctgtactaacgaaaagttacaacatcggttttcttaatgaaagtgcaatatttctgcacaaactatacgaggatgcaagtcgaattgccaatgaatcagttggaagtatcagaacagtggcaggaagaatggagcgcacaggtagcaggaagaaaggagcgcacaagttctgctccaaagatacaaaaggtatctctttctgcttctgttgtgtgtgtgtttaaactatttctccaaaggagattcctcctatatatatatatatatatatatatatatatatatatatatatatatatatatatatatatatatatatatatgttgctaagcagccacaacttgttttaattaattgcagtgtcaaataatactatagagcagatggatattgttgttctgattttagggtggttttacttaaattctgacattttccctggcaggttaaagataatatttttcaaggaaatagtagctaacaaccctttattggtttttttaatttttgtgattgaaaagaagagagttatgctctagtaatgaatagtggaatctaacattcatcaaaattctcttctttaaaattccacaagtatttttaccacaattgttgcaatcattgggcagtctatgaaaatctgttttgaactctagttgctagagatttcttttttaattggttttcatattttttccgagcccgaaagatttaatatcttccactactgaactactaaagcactttccttgtcctatctaggccatgggaatccaatttgaggaggacatagttatggagatcctcgccaggttacccgtgcgctatctttttcagttcacatgcgtttcgaaattgtggaaggcatcaatctctgatcagtgataaaaaaaaagcgagtgcttcctcgcattaagcaagaagcgaagcggagcagaaggttcagcgcttctgccattaaaagcgattctggtacgaaaaagcgaacgtttctctgtaaaaagcgagaagtgatgaagcaagaagaagcgagagaagcagacactttttttaattaaaataatccaagcactattttattaaaaacttggtattctgttttagtctggacttcttgcacttcttcgagatttcaacagcagcaagaaactagggtttttcaaacaacaacaacgatttctttctctcttcttcattaacttcaaacaacagcaacgatttctcttcttcaaactaggattgttgttcttcttcttcaacagtacaacaacaactttcaacagatatgttctgcacttttgattttcattcttcttcttcttcttcttctttttctttttctttctaaacgtccaaaaagagtcgaaatgctagcgaatttttttcagaaaaattctgcccaatttttccagtttctgcctaatttttgctcaaaatttcagcccaatattatattttaattcttttttaaaatttcgcttcacttaaaaaaagcgagcgcttcgtttctcgcttctcgtgaaatggggttgtcgcttttcctcacttcacgcttttcataacactgtctctgatccatactttaagaagaagcatctcaatcatgccaagaatgaccgaaattctcaaaaacttcttattggcccaaagtgcagttgtaaggatcatatttgtagcttctattcttcttctttatcggcacttcaagttgttgtggatgaacaaacacttcattggccttcaaacgacaaaccagtggttccacaatctactttaagaagagcgtgaggaaaagcgacaacccccatttcacgaaaagcgagaagcgagaagcgaagtgctcattttttttaagtgaagcggaattttaaaaaaaaattaaaatataatactgggcagaaattttgagcagaaattaggcagaaactggaaaaattgggcagaatttttctgaaaaaaattcgctagcatttcggcgctttttggacgtttagaaagaaaaagaaaaagaagaagaagaagaatgaaaatcaaaagtacagaacatacctgttgaaagttgttgttgtactgttgaagaagaagaagaacaaccctattttgaagaagaaaaatcgttgctgttatttgaagttaatgaagaagagagaaagaaatcgttgctgttgtttgaagaaccctagtttctcgctgctgttgaaatctcgaagaagtggaagaagtctagactaaaacagagtaccaagtttttaataaaatagtgcttggattattttaattaaaaaagcgtccgcttctctcgcttcttctcgcttcacctcttctcgctttttacagagaagcgatcgctttttcgaaccagagtcacttttaatggcagaagcgctgaaccttccgcttcgcttcgctttaggcgagaagcgctcgctttttttatcaccggtacatcacttttaagttgtggtaatgaaagactatggtgtcgaggaatcttggactgaattgcatactatacaaggctatgaccttttttttccagccagtccgctttatatgtttgcggaatgcgactagttaataaaaatgcctttgtatacctttgcatcttgcttgttatttgggatttttatacaaatagccggccaaaataataaagtatttattggaattattatgttcttctagtatgtaaaatcttcaaaatggaaattaattaaagatatagtattttagaagctctaatgtacactcgagacaacaacatgtatttgcaacatgtacttgtatgtacaaagagtatgtgtgtataattgtgtcttcgtgtttagtctgtatcacgtagaaattatatttttttgtttcttacctctcttagtaaccgaagatggctcgcgtatctagaggcgggtccaggatttaacgacgacgggtgccactattattaatacgaacctaccaattgaaatagggtgtacattctgacggttcaacccatttgaattagttcggttcggttcgacccgatccattataaaataattcaatcagttactagttttttagtacataaataaatacgtgatcgccaaaacaaatgtccaattcgatctagttctctcaatataaattctatttattatgactaaaaaatataaataaaatttaagttagcaaatacatctaatcaaccaatatataactagatagtattgcgtttattgattccattacttttaagaaaatcaagaaaaatatagtattagatgattaaaatcacattcaaataaaatttaaagatttagaatgagaaaaaggaagcaaatatataattctaaataaataataataataataatgaggttgtacaaagaaagaataaatacaaaaatgaagaaaatagaaggaattaaaaaagaaaagcaacaataaaaatgaagaaaatagaaggaactaaaaagaggaacaattgggatcacaagctgaaaaaaacaacaggttaggattaagggggatccgatcctgagtgtagcacgtggaaacttggcaggtgaaccgtggcacccgtagtcattttgttatttttgggtgtcactcaacacctatatcatatttttcagtaaaataccaatacataaataaaattttacacgagcgtccgggtgtcataccaccctaaagtctctacataaattcgcccctgcgcgtatcgtgagagttgtttgcttaggtaactcaacctcagctttgaaggatgacccttctttactgtgagtgcatttttacattaattttgtcaccaacaccatttacatataaagattgttgcagagactttgttagtcactactagaaatctggtatttatcgactaaattttgcgatcaaagttggtctgttaaaaatagcgatcaaagttggtcggaaaaggggagaaaaatattttatatttattttaaataacttactgaccaacgttagtcggtaaactggtcaacaagttgaccgagctggtcagacttacttggtcaaagaaactttcatattaccgatcaactttgatcggtaatatgggaccaagttataaagttttaataattatatattatttaaaatgttttataaaatataaataattcttatttaaaattagcgaccaaagttggttgattaatacaggagaagcatttaacgaccaacgttggtcgctattttataattcttgaacataaccgaccaaagttggtcggttattaggtcaacattggtcaaaattaaaaatcacttttatatttactatctaaataatataaatgtaatccgttaacacttttgtaatacaagggatgaatacactaacatatactctaacatgctatatatgtagttaaagtagtacaacgaagcgtgttttatataatatatagatatagatatagatataggttagacgttttgttttttaatattcaacgatacatctgagtaggttataagtcgatgaatcaatttacacacagatatatttgatgataaattatataggcggtgattatacaaaaacttattagaaagaaaggaccatgttcttacctcagcaatgaacgatatggtatcaactacataaaattatttttgttgtttaatacaacgtggtgtatcttcaagcttaaagtacatgggtattcaaaaccgtataagatgataaaacctgtcccaaatttctacaaggttttgttgggtttttaagcattaataagcttaaaatagggtgaatggaaaatggagggaaaaataaaatatttgagtaatatttgagcttcccttcttgattgtcccatatgggaaaaggaaaaggtttttgatgggtatataagcaattgttcttcttctagctattaaagagttgagagaaaagcaagcctcgcgccgtcacttgctcggtaatttgtaccattgcaccaacgtgtaattcgttctatactgggaggaaataatccataaccttattctgaagagtgaagatttgagcccaactttggctataaatacaagttcattctctcagattttccatacgaattttccgagttctccatacgggtactaggaggggattaaattccttaaggaaacactgtgaattcaatgagctcgaattgattttatttcgtttacatttctatgttaatattattttctattatctccagaattattttacaaatacagattgataacagtttcattgattaataaattaaaaaacaagcatttcttcaaaagttatgagtttccactaaaaatccagtcacacgatgtggttactattgaacgcagcaaattcatatatgctcattggttatccactgagcttcagcaactacagggttagagttgctgtccaatcatttgcaatgtctatgctaacaaagttgcatcactttgatgttaccagtacactcactgctttcaaaggagagctggtgactattattgcatggcagccaaagctgctgggaagcaatgtcctgactataagctggttaatgaaggttttaagctcgctgacggacctgtgctataccgagaggggtcaccggcactcgtaaagttcggcaaatactccatgtagagggccgcggtagctgccgaatcttctactggtacatggacaactgtatggaccgatggacttaccaaccttgatcgttataaagggcgatgctaccgcatcgagcatgttgttggagaaaaagatcaatatattgcttatgtagcttaccctttagacctttttgaagaaggttctgttaccaacatgtttgtatatgtctttagaaaatagtgatatatttataatggacaccctatatacaaagcagattttggttgaattcaaaagtgcaccctcgaccttcaaatcctgggtccgcctctaagctcgcacatacagaaatggcacagaagcacccatgttttggatttgctgaaaagattcctaacattgtgtggtggaaaacttgtgtcagggattcctttgttaaggtattgtacaaaacattatcaagcttttcagtattctataccttattttggaaactacatatccattctgaaaatacagtagcctttgactattccaaaattgtggtttgatatctaaatgttagaagttggttattttagtactgacatttagtatcttttttacaggcagggatatgagtatgatgaggagacatttgagaagatatttagatgcatatatgctactttgttccttctgcaccttatagcatatttcctgattccaaaccatttctcggagaggggcatcacaattgggctggtcagcaatgccgagtatcggtatcaggacgtaattcttgctgctttaggcttgcatcaggtagataaacaatagttctgatttcattttgcaacattgaatcttcttctaaccatttttggctgaactgttaatctttttccacaaacactgaccatcacaaagtagttgtgaccctcttttttgtgtctgaaactaaaatcagggatctgagtgggactttgggcgtattctccggtcttgaaggtgttgaaaaacccgatccaaggttatttgagattgccttgaagagggcaagaaatgtagcaccggaagaagtacttcatattggagatagcatgaggaaagactacttgcccgcgagaagtgttgggatgcatgctttgttgttggacagattcagaactgcaaatcttcatgcaccaaaagatataagcttaaagagatatttcacagtcctgcattgaaattttcagcaattatgtcatatatgtcattaattcagtgacaagcatttatcacataaagaataccagccattgacactttttgactatgcaattcccaaatatatgctaactcctgctaataacgcatccatttccgaaagtaatcttattaggacacaagttgacttcaggtagtcctcaaacacaacagtaaaactagatctagaggaatccacagaggagggttcaattaacccaaataaacatcaaaatagataccagttgtttctcaaatgaatttcatcagcaagtagagttctgctgttaagatgttctcatgacccctattcaaggattgtaatcgaaaggaatataattccaatattccctacgcttattattaagtccatattgtagtgagtgagaagagctctcctgaggggaaaattcattgtgaaagtgagatcactcatcaaatatcagagtataaggccatgacaagtacaatataagaaacccaaaactcttcaacacatacaaaaaaaggagcctaccaactggatcaggagaacgacaaagctgatcttgctactctaagaagttaatgctacacaaactctacaacttcaaggaaatgtataataacttgtgtaagctaggacaggaggtcgctattccacacaaattaatatgaggaaatcttttaggagctggtgcctacagctcagcgaagtaaacctaacaaatacttgaaggacggagacatcctataagtgtttagaacgacaacggacgccacatcaatccagcatcttttgtttggtgatcatcttaattctgcatgtatagatgatgttacttgtaaccttatcataacagccatctttaagagaaccaaggaggcagtgacaaatgtcaagacattaaataagatggcgaagaaatctaccatataataggattgtcttcatgcgaactttaaacaactttttaagctatgttacatggacttttcaattgccttggcatacctagattgaacaattgatatcagtccatccaatccttcaaatacagtaaaattgctaagttggaccgccaaaagggatacacatactgacaccttaccaaatatatccatacctgaatccagaacataggactgaacactttcatttatacacatacaagtaaagacgaatatcgcctaaaagggcaggaaaagacaaataatccaggacggtcgcaaccttatctcaaattcatgagctcacctggacatggtatgagcagaaggaacaataaatcaattgtaggttgatccaagatccaaatgttaaccttatgctagaatccaagaacctgctaacttcagtataatctcagttttcttataagattgcacattactcggaaataaatgccagaaaataatcttctgattaaataatagtctgacctgaaaatcgacagtcacttagaagaagttgcaaaaatgcttaacacctaggaagaattaatccttaaatatgttccttcagattataaataccataaacgattaacctctgttctaccacttcttggtttttcctaaataccaaggggcaaaatctgatctgatgccttccacaactaatcatgcggacaattatttcagacatatttatataaaataacaagcatatcaactttgacagtgatatagaagatattaaaaaacaaaacatctctattgatgtgccagactgccaaaaacaattactcttcatcacaacctactcaaatacagataaactcacaaaaagtttgcacctttatcatatttaaacctgtaagtttcaggtttataaatcctgcagctcagtgaaaaccaagccaaacatctccataccataggtcagttttacctataaaatttaagcattaacgctattcaccatttcctcaattccaaactactagggatcagcagaatgttacatcaattcagcacaaaagacaagtaaacctttcgtgtcaaaaacaaactcattaaccagtagcataatgactatttataaaccacagtaagagcatgaacacctcatcattaggactaaatcctaatccacaccggttcaattcaaatttctgaaacatcacaagtccacttaacaaaaaatataataagatgatcttcattttcctcttcttttctgtaaggtgggttcattcaaaatgtggtaacattaagaaaaagtaaaagcaagaattttaaagttcaaccaatctacctcaccaaattaactcataaagaacctaacatttccaaggagaaatttttcaagttcaagaacacataacagctacaaaatcacaagaaatgcatgcttccgaatccaactatatcttcatgttaacaaacccataactttttagacgaaaagatcaaatttttacacaagaaatgagacaaacgatggatttgaagcatacccagaagctcaaatggatgagaaagagaatggcttcaataaaattgctatcttttccaagtaaagtaagattcttgaagcagtatatgtatattcaattcgttactttgacaaaatatttgcaccaaagtcctttaggtttgttcattctacatttcggaccttgtaataattattttctttgggcctatgtatatttctgaaccaattatgttatggcccatactatcagcccaaaatttggatatggcccattaattcctccacaccatttcaccagcaagctcttacccaaaaaccctaaaccctctggttctataatctatatccttccagcttcaatcatcagccaccccctatataatattctcatttctcactctgttaaaaccctagacagtgtgacttcttaaaccctacctgaacccctccccccaaccccccacaaaacgaaaagccgccatgactgacgtcgagctctctcgctcagagaagaagaagaaaatcaaatcacccaaaaatgaagacaaaacccaaacactctccactcaaactgacaaaaaatctgatcttgatgtcgattttctcatcaaaccacaaagctacacccccaccattgacacttcacagtggcccattctcttgaaaaactacgaccgtctcaatgtacgaactggtcactacactcctctaccgtctgggttttcgccactcaagcgtccactcgctgaatacataaggtacggtattctcaatcttgataaacctgctaacccatcttcacatgaagttgtagcttggattaaacggattctccgggttgagaaaacgggtcacagtggaactcttgatcctaaagttactggtaatttgattgtttgcattgatagagcgacccgtttggttaaatcccaacagggtgctggaaaagagtatgtttgtgttgctaggttacatgctgatgttcctgatgtagctaaggttgctagagcacttgaagctcttactggggctgtttttcaaagaccacctttgatttctgctgtgaaaagacaacttaggattaggactatttatgagagtaagttgcttgagtatgatgctgataggcatttggttgtgttttggatatcctgtgaggcgggtacgtatgttcggacactttgtgtgcatcttggattgttgtttgggtgtgggtggacatatgcaggagttgaggagagtgaggtctgggattttgggcgagaagaataatatggtgacgatgcatgatgtgatggatgcacaatggatgtatgataactatagggatgagacttacttgaggagggtaattatgcctttggaggtggttttgactagttataagaggttggtggtcaaggattcagcggtgaatgctatttgttacggtgctaagttgatgattcccgggcttttgaggtttgagaatgatatcgaggttggggaggaggttgtgctgatgactactaaaggagaggccatcgcattggggattgcagaaatgaccactgctgtttatggccacttgtgatcatggtgtggttgctaagattaagagagtggtgatggacagggatacttatcctaggaaatggggcttagggccaagagcttcgatgaagaaaaagttggttgctgaggggaagttggataaacatggaaagccaaatgagaaaactccagctgaatggttgaggaatgttgttttgcctacaggaggggacgctatggttgctggtctcgctgctgctaatgtgaaaactgatcctgatgcggtgcctgctgatggtgcagttggtgatgttgagaagaaaaagaagaagaaacataaggaagatgaggaggagggtaacaagagaaaatttgatgacttagatgcatcccctgcacccagtgctttaaagaaaccaaaggtagagatagtcgaggagaagaaggctggagatgaagctgtggaggttgaagtcacaaagaaagaaaagaagaaaaagaagaaagaagctgatgaagctgcaacccctgatgtagagacggcaaaaaaggaaaagaaaaagaaggctaaagagaaagatgttgctgcatcttcagatgaggagaagtctgagaaaaagaagaaaaagaagaagaaagataaagatgcggacaatggtgatgtagctgttgggagtgatggcgatgaaggaagtaaaagcaagaagaaggagaagaagaaaaagaagaataaagatgcacaagatgagtagaggagaagtcttggcccccttgaccaatcaatgctcatatgtttgtgttaatgtcactcccttattttctttgtgttaatggttgtttagttatcaatagtcatagaaggtattaatcgtactatatctgcacctcattcagtcgtttaacttggtattattcttcgtcttcttatctttcctttatgaactagtatcttgttaaaccagcagcaagaggggagatacttctcttctttttgaaactcaacaagagttgcattcctttcctttcagctatctttttttgtttccagggtaaatctattcattttaagtggccttttggtaacttaatcatgttagcttgtgtaatatgtttcaaaaggggggggggggggaggggttgaatttcactagcaaaacaagaaagacaaatattctgccattcataagaatttgaacaaaagtaagaattgaagtaccaccttataacagcatggaagcgtaaaagccacctattaataggttaaagtttattgggaaaataatgaatgaaaataagtattcaatctcgatgaatatatttgtcacttgcctgacaagaaactttagatgctgagtcttgggccacgcattaatcggttaaagttttttgttttcaaagcatttaaacagtgattcagaaatttgcaagcctgtgagatgtattggctacatttgttgcacctgtaactcatactgcagaatggtgctgtcttcacttgtggcttaaggtttcgcagacatgctgtgttcagagtgtagcctaatgcttttagctgtttgtcatgattcaaagcgatcattgaactctaagctgggtctgtacacgtgaaggttatacttctttttgatgtttgggtgatggatctgattttatgactgccaatcagttttgatattggttcaagtaggatcttcaagtcatagctccttgacaggcactacacttgggaattaattagaagaagcttgcccaatggaaatgcatcccgagaatggcattagagggtactacgttgctcatcctgagtcctggttgaggtaatttactttcatattttctgtgtgctctgtgtcaatggttgtttagttgtcggagtcttagaaggtattaattttactatatccgcacctcattcatttgtttaacttggtgttatcattcatcttcttttctttccttcttgaactagtatcttgttaaaccagaagcaaaagggggaaatacttatcttctttttgaaactcaacaaagagttgcattcccttcctttcaactatctctttttttttttggtcagggtaaattccttcctttcaactggccttttggttaacttgatcatgttaaattgcaaaagttaatggggtgaatttcactaaaaaaacaaaaaaaagacaaaatattcagtcattgataagaatttgaacaaaaagtaagaaaccttataaaaaaacatggaagagtaaacaccatcaaccaataggttaatgttgtgttggaaaaacaatgaatgaaaagaaatattttatcttgatggatatttgttgctagcttgacagtaaaatttatagaaaaccatatatttaagaccatgcattttacccattaattcaaattagaacattgaaaatgttcttgtacatcaatgattcaatatctatcaagttgcattttgtatttttcttcctatatttgtgtattttctaggtctaaagattgcatatagacttcacgtgagacaaagaacaattcaagccattgttagtggtaaagattctcaaagatatagttctcccaccaggaagggcttgaggatcctcttcccttaaaaagaaaagacgaagattgtcaagttaacattcttctttttttctcatttttggggtgtgtgtggggagagggggggggggggatgttagacttggatagagagttggtcaccaatttccttagcctcggtctctatttgtgtgtgtacaggcgaaaactttgtaacatatatatttacactaattctgcaatcactaccaccatgcatactaatttaaaatcttaaatctgtttccattagggatagcggagggtaaagaaatatctctgttcctttaattacattttctattcgccatggtaatgcaatgcatgatgttggaaattatattgaatcttatcttgtctgagatatatgaaaacctgaaatgtcagctcatcttgattactcattgttgccccctttccaaagtctcatcactttggagataacaagaatgcacgtcagaccaatctcaagatgttcaatgttaaccaaagccacggagacacaaccttgtaccccatatcagtggtgaagcaaggaattttactaatggtgttcaagatgttcaagatttaatatatgtacaaattataagggtgttcaactgaccatcattcaccggctgtagctctgcttcttgtctcataagatgctgctctgtcatctccggatttgccataaacaactaccatagctccttggtattgctatttgagagcattccgttaatactccttgttgaaagcaggaaacaagaacatagatctaaggtcattgtttatcatctgcctctgtcctctgcctgtgctgaaagattctgcagtttctgtcctgccaaatgtagtacacaactgctgccaatatcatcctgtacattgctgaattaatatgcctgcctttacaattagtaacagcccagttgagctcatcatgcaatgccaaggtgcattatggtaggtattaaacatttctttgaaatgttctgtcaacgccacaggaaggtaaatgatgaaatccagaacacagtctatcggtttaatctctcctgcctctttctattcactaaaattgtggatcatattaaataaagcgtatgttgtttttagacataaccaatatgatgaattctcctaaaggttgacatcaaactagtggcagcacctcttgtgctaatcagataaagtataacttggcagtatgttacgtgactttcacaagttttcactactcaaatctttttactagtcaatttctgatgtgatgcttttctttctatataatttttcaattgttctaataattttgttcactgcgtattatatatgtaatgacaagtcaaacaaacaactttatatccagtcaaatagtgccaaaaaactgaaacaaatggtccctttgaggacatctgataaaagaaataggacgactgtagtataataaatttacgagaggtcttccatgcaaaatacaatatgtttagcaaatattgaatgcttacatccattttctttacatcaaactgagactaactgccaatgaaatgccttcattctctttacatctttgtgatgcaggaaaagagaattaaacaggccatctggatgtccaagttactgcctaatgctatgacaacaaaagtaaaaagtgattacagaagaatggatattcgagtaacaaaattgtcttcgccactccagatatacaactcttcatactgggacagtatccaagcccgcccgtgtggcgtaaatatgctccagtattccaccattcctcctaaaaacacagcctgagaagagcctccatcaaagaatgacttcatcgcctcaacagcttcttctacctgtggctgtgcttaggtcgaccacatcgttttacatctttacttaacaaaagcttcaaagctttttccagggtaatgtttttgggatttaagttctgtgaccaaaatcagtacaggcaacttctcatggaaaaaagaaagaaacagtaaattataccgttaacctacttcaaagtcattcaagtagtcattgatcttgttgcaatttgtacagattttattactcccaaaagaaaagtgacactttatgaaacgtgttgtatgataattagcaataactaacaggtgaaacaacatactgaccagcactgatattcattgatatggagttagcagttgtagaaatatttgtaatcactagagtagtcttaaggctgatatacaggaataccaagaagattaagcacaaagttatcagctattctgatgactgaaaagaaagaaactttgataccagaattctagacagaagggagacacttgtacaaaatctattacttctcagtagattaagcacaaagttatagaagtctaatgattatgaattgggagaaaatgcttaaagtattcctccatgatagatactttttcctgcttcagtctcaagtatatcatcaatttataccagtaaggcagcattttgaaaactggagagctagacaacacaaacttcacttttcatccatcaagattgcaggagaactatgatgttgtaatagtgccatcactttttatcatagcattaatgattccactaaaattttctctgataaataccttataattacagttaacaggggtgaagcaccaattttttttaattcagcagcaagctagcatatcaaaacgagattcgactgaaccaaaccttgggtactggagcaattgtttgcctatgtccgattgtaaatccaaactttgcaagctttacaatgacaggctggtgctggtcatcatctgtaagcgatactgtgttaaaacagaaatcagaaaattgttagaagaaacagaaactctgaaaatgataagaaatattccgagtccacaatttccttgtgcgtccttaaggaattttaaccccctcataagttgccaaggtaatggattaaatcctcccaggatgaaacggaataaaccttcctgcaacaatggcaatacaagctgcaggataccaacaaactcaaagaacggagcaaaatcacacttacgaatttgagagagagagatactgcgaagaagagtgcagtattcagaagttgattttcagtaaatgaaatggaagccatgcctcagaatttataggcaattattggaagaggtgtgatgtctgttcagaagggaaagtaaacgttcagcattgttttggatttcagttaatttcgttaatgaactgactgacatttaattaatcttatctatcgatcatttgacaaatccgaagccgaagccgagcgacgacgacggcgcgagggttcattctcgtcaactccttttaagagctctaagaagtgatcttatatttatacacacaagtgtagttgtctttcaccaatatggtacaaagttcgacaaaagttcacttgatttaaattttcatttccctctattttatttcccaccatttcccaattcacactcttagtctttaaagcccaatgctttaaagtccaacatcatctggatggtttccctgtaaacaagacccattcatcatttgtatgcatgctgataaccagtgatagagaaaactaaaactgaagacagaaataacttgaaaaaaaagggagtacatattcaaacatactaatgttacagggtaacacagcaactccaaggtatcttccaaggtaacagaagtgatatccttcaacttgatcatggaaaatgtattcatccgagctgaacatagtatctatatggtccattcttcaaaagaacctaaggagaaagggcataaaggtctttacatctctgagaacaaacaattaacagaaagtaaagatcaactagtataaccagtattttggtcaaaagatcaactagtataaccaatccattgatatataaagggttgaagtggtaacctttcatttgaagatggatggacaccagcaactttggcggctctacatttcttttattgtcttcagaggtgatgtcttcatcctcttcaccatatcatgtcttggcatatacctaagaatgaatgtcaaagctacatcagccaataacttgaaaacgacattgaacgagaaggagaaaaacaactatatttctcttcattgttctgcactatcaagaataacaaatccattatactgctaagagattcaaaagttcatgtgcttacaacttacaaggcatgataactgaaataaagatttaatgctggaaacgaacgaatacatgcccgatacgtttaaagtagcaactcaaagtgcaaaggatgcagaagttagaacaaaaactaaaagggaagaggagactcttgttttccaattgctttgcatgggataacagtaaagggtaaacctttaccttatcggaaaaaagggataacagtacaatctttaaggaagttcaccgagacttaaggtttagaaggaaccttcataattgggaggtagaataaattcaaagtctggttgaattagtctataagcaaagttcttcacatgacagccaggattactgggagtcaagggcagggagtagtgggtttatttttagtaaagtcctattgtaataagctctggatccgaggcgtatcaacctttccacatctatcgatttggagtccaaggtgtaggatcaagcgcttatcatcatgccaaaagctatagctgatagcaagggcgcaactttatttcttaaccaagatcaccaagcaaacgctatgttcgaccatgactccgacacgggctaccctagccctctcgtgggccttgccataggcaagatgttggcgttacccaatacaagggcaccatgaagattgtgtttgttcgcttcgttggtagcaaggaagacaaaaggcatgggatgtagctccattagcactcgtgtaaatagtatggaaagagagcaataggaaagcttttgaagggacagagaatgactttgtacatttgcggaatagtttcttgtcccttatttcttttttgtgcacctatgagattctaatttctaaagatcaggtgtcttccaagagaatcaaatctcttcaattccaaagagatcattccagaggactaagtactcattatttcagaagtgttgcacttccttcaaatgagtgcatgtacatcacaccttctatggttgttgccaaagctccgagtgaacccgaaataagccacggacttggatctaccaaatgataagaatgcctctgagattcaatcataaatcactttgcctcggttttatgtaacccccctcaccccacccctaaagtagtaaagtaaataagggctctttggagtctaattttctatctgacaggacaaacaaacaaataggaagggatggtctttcattatagcagcttgacaatgatatagattcctgctgacccgccgtgcaatgttgcatctaatcttaatctaacagcagaagattccaaatacttgctttaacaagagagaagtatctaaactttttgaaacctgcaacccatgcaaatggtaaatcaaaacatcattaatatgtaaatgcaagaacagattccacaccaacatctgtggtatcaggagaagatgaaacgacagtatttaaaagatccaaaatccatggtagctcattactcacttgcattttgagtgttggtcacaacctataaaatagcctgcaccaaacctgctcactttgaagattaaaattccctgaaggcaagcttgggcatgtcctactttcatcaggaagagatgcaaacagaaaatcaccaaacgttttctccaacatcttctccacctgatgaatgtgcgcattaccagtatgttcacaatactgctaaatctagtccagtaatctctcaaaaggcctttccattcagccaaaccagcagagacattatcaagttctgtctccatgtcggcagtgaagctataatctgttacttcagtaaagtaatgagagagaaatgctgataccatacgcccacgaaattcaggatagagtgttctgcctttggcagtgacataattcctatcctttaacacttttattgtggttgcataagtggaaggtcttccaatgccgagctcctccagctttttaaccaaagacccctccgagtatcatggtggaggtgagtgtggtgttgctcaagttttactttatccaaaaaacatttgatccccagcagttaaattcctaagagcctcaaatacttcagaacgatcatccctcccactttcattatctctcattgagttagtttccacatcctcgtagacagcttggtagccaggaaactgtacttttgagcttgcagaacgcaagattaggactggtcaggtttcccaatatcaacttgtatctgctcgatcatagcagttccatctggcatgccatggtatggaccatataagtttgtatagcctaagtgcatcatcgtccagcaccccagcaagcgttgagggtagctttcggatatcagtgggtctaatagcttcatgggcctacgtatattccttaattagaatatgctgaaccttgccgctattaaatgttctatacttatgttacactaaaactatttccttatgtgttatatttagccttatgtgatctcctttcttattgtctattacctttgaagctaactccttaattaaagggatacttatactgatttgattctaattgatacatagttctataattactgctttactatgattcttgccttattttctacctagtctaaactatacatacatgctctctcattaacacaaacacacgaacacattttggttcaaaaactctctctcacaatcaaaagctgttctgctttcttcttggttatttgctatttttctaagttagccggctgtaagtcaaggctgactactatattctcttactcctcactttgtgtttactatattctccactggtatgttctgatttcaattcaagtctcaaaccaatgtattttcctactgctttagtttatcatattcctaatctctttctgtctactattttgctgttcaacatgtaattaacttgttttgttgcacctatcatgctaattatgtcataaacctcttaggatcagcttacttatgaatatattactccttttgttatgtgtttcaaactgactatgttctgtctatgcatgtctgaatggttaactaattgatttccctagtttctagtacaaacctgttttgtaagtgattcgttattctaagctattctgatcatatgctcaattctgtttgatatcactatgtcttccattgtttgtcctaagacccatgctatgtttacaccattagttattcccaatcccatgaaccttccccccccccccccccaaacacttctgattctataactatgttctaattagcactcctgaatttatgtcccactgtttgctctattaactactccttaattacaaagaggcttctgtttattatatgtattatgtgcccgtccccaatcaaccctgtgtgaaagggtgttaattgagtgttgctgaacctatttggccctgtgtttgatctgttgtttgtttgattacacaactcttgttcaaactattttttaccactaaaccattttatactatctcaattaaatcccttttcaaactgttttcttactcaaacccttttcaaaactatgtcaagcactctcactctattcttaggtccttaaattctgcccctctaatgtgtgattgcttaggatccctatgagatccctctgaactttgatgcattagagctgactcttccacactacgcttactcaattatgtttgtgaaatctgggtgtgagcactgcccaggatcctttgaggtccttagggaactttgacacacccagatatgagaaaggctatgaaacaattgggcatttgaggtcttggcgatctgggcctgttttcaggctccctatagtgtaacttcttatttttatttatctatttatgtagttattttaacattggtttgtaataattgatgtaaacgaatattggggctagctagtgaaaaggggagggtagttatacatgttatcaatgtcaataggtagaaatcatctctaggtttatatttcttatatgtacattagaatccatgtttaggaccaatgtatttaaagcatgtcatgcattagatatcaggttcttaggtttcatgtatattgtccaacatctcatttgatattatcacttagaaatcctgcctctaagataataaacagcattaacataaaggttgactcctatctgtttaacaatgttgtaaccatattgtgcatttagaaatcttgctttaggaatttgcatataaatcattctacatttttacatgcataatagataccctgttctaggatctatttgtactcgcccagtcacacctagctaaactactgatgcatgtaaaaggacataaaaaatggtttcacgtttaattatcctgtcttaaataaattgataataatccctgtgtatttgcaaacacctagaacaagcatgctttaggaaaacaacttctaagcagttttaacaactctagtatctactatgcattatcctacgcctaggcaagccttaggtaaacagcttttaaattggaagctgtttcttttgttattactgcttaatggttagcaggtttttaaaaaaaaaaatcagcaggaaactgattagggccctattcctgagtttgtaaaaaataaagttgtatacttttgtgcattgacatccatttagatatcctgtttaggttcctttttaatagtacccccttgtttgtgtttgagtcgtgctgtttatgtgcgctatttgtggaggtaaaactgagcctctaattacttctttctgtcttatttgttaaagtcttacttgttcttgcctgtcgcctagtattttctccttttaaccttaggggtctgagagaactgctattggtagaggttctaaattcctccaggaccagtaagaagggacgggtaacagcacgcatagagatcgttaacaaaactttcttgataaccgctaaggggtggggtaaagggtagatatagatatgatggccgttacgttaatgccacgtgtatcccctcattgaggagtgattaccgatatattgtatcaaggtgatcctatgataaacaatctaggattcccctatccctatatgtgtgcttagactgtaaatcttaaacctcatattgttttagactttaaatccttttttgaaaaaaaaactttacttcacatgtgtgcttagactgcaaatcttttcaaaactcctttatttgtttattacttgggtgctacttgtttaaattcacaaagtttgtttggtcgggaaccactgttgtggactttgaggggtgcctaacaacttcccttggagtaatttcaagcccgtactctatctctggttaaccaattagttgtaataacccttagtaggtgcctaatgcaccttaatttttaggtgacgactcttcaattccttatatccctatccaaaaggaaacgagtttcccaataatatcaaaaacccttaaccgatccgaaggagaggaggaaaaaagggggcgcgacactgaccgtagaatccgtgatgtggcattcatggtcgggagagggtgttgcttcgggtgtcatccatgaaggtgtcatgagatttggaaagaagggcaagttgagccctaggtatatgggccttttgatattctcgatagagtgggagaggtggcttataggcttgcgttgcctccagcgttatcaacagttcatctggtattccatgtgtacatactccgaagatatcatggtgacccatccacgtgttagtttcagatatgtccagttggacaaggatttgacttatgagaaggagacgatagccattttagaccggcgggtttgtcagttgagatcgaagagttatccttcggttcgagtgcagtggagaggtcagcatgttaaggcagctacttgggagtccgaatcggacatgctgagtagatatccccacttattcaccatttcaagtacttttctatgttcgttcaaggcgaacggttattttagaggtggaattgcgatgaactaaggtcatttatattttaaaactcaattctgcactctttaaccttaaaaatctcatttttactctattcgattacgtgacagtccaggccgtgatttccggaaagattctatgatatgatgaaaaataattttggccttaaaagttgattttagttgacttcggtcaatattttgcgtaaacggacccgaacccgtgttttggcggtccgatgggtccgtagtaaaatatggcacctgggcgtagactcggaatcgaattctgaggtgcctagctcgacatatgaatttttgttaaaaattgaaagactgaaattttaatggttttaagaaattgattaacgtttgatcttgttggtattaggtccgtattttggttcggagcccgatataggtctattatgatatttataccctatctgtgaaatttgatgagaaacagaactgatttgacgtgattcggacgtccggttgagaaaatatggaatttaaaatgttcttgagaacttcatatgttttgttgctaaattcgtagttttgttacacctccttttttccgagaggggtatatgtgagttttttcatttaagtgacattattcgatttgggattattttatatttaagaatcgccacttgaaattatttatttacggtgttccgagtcaccatttattttaaaatcctaatcgaggaagtttgactctgtttaacagcatgcgaacacaaaagatcgggtaaaaaattttattaacccgagagaagatgttaggcatttccgagtttcgtggttttagcacgatcgctttaacaatttatacttggcttatttgattactcaatttagaacctaagtacatttttacctcttaccgctcttaattactcgactacttgcatttaaagaattatcttaatacaaattatgcgtacgtatacccgtttagtttggcgtgtcaagaatcatgtcacgcgtgcgtgtacacaattcacaacactcagtttatttaagaaaaggttagtcaaagtcacgtgaacgcataccttgaatttatttgaaaaaatcgtaatcacgtcacgcgaacgtgtacgcaatcacgatagtagtttaaaaaccgcgcataaaaacatttcttacgagtatttgattaaggtttactttactaagaatatttgaccgtggtcatgcgaacgtgtatcttggtttgtttttggcatcacaactatgtcatgcgtacgtatacataattgtaataattagttcgattataagtatacctaaggtttaaatcatgttataagctaaatgtcctaggtcttctgactagacataaagacctactgctacatgagacattcatttgaattaatggggcagcttacccattagttgcccaatgaatctataattaagaggctttgggtctgataatgggtgagtttaaatgccactggcccaatgcatattaccaatcatttagccagctaaatgaattcaattcaaagaggatttgggcctgaagatggctgagcccaaatgactctggcacaatgcttttttttatttgaacgaatttgagactgaaatttcatggtttatttctgtaataccaatcatagaattttacttatatttcattgtgtttgaaaatacatgctaagagatatagaaaataaacagaacaagttacttattcgaaatcaggctcgattttactttcaaagcatttttgttttttatattataatggtattaaaagcagtatatttaaccatttatgtataaagaagcttcaaaatagtaatttaattgattatcagcttagttcacttaccagagctaaaggtataattccatatgacccaattgatttgggcctgaaaatataccatcctatcgtccaatttgtttcagaaacccaaatatgaaaattctaaaaaaaaattaacaaaaaccagaattaatttccttaaacaacacagccaaattaactaatatattaactaacatgttatacgaaaagagatagtaactaaattattacaattattagctaaccaactgagtttcattccttgtctataaagataataaatcttacaattctttttctaactactgttttactcctattattgcaactaaatacataagttttcagggtatgaccctttaatataaacaaatatatgaaattcgaatagatgctaaacaacctttaagaaagcttttaaacatgaaaagacacaacttgaatagtataacgaccagctttacacagatttgcatataatgttcaactagactaatttcaatcaatatgattcatgcaataatttaactcatacccaagactacattcaaacaaaacacaatttttgacaaaaccaaaaaatcataattatgatactaaaataaaaaatgaagcagaatttttatattgttaaaagtagtaccttgatagcagcaagaaaccaaaataaagagagaaaacaaatctctgacaattcgagcaaaaaagcagcagcaagaacacttaaatggagaatcaaaagagctcccaatttcaaacttgaaactcagtagagtaaggaaacattatgatttggaaaaaagggaaagtaatattttttttggtgtttctgaaatatcaaagctagttttctagaaaaagttatttgaaaatcaagggaaaagacattggagactctgtgtttttagggaaattttggtgtgtctatgtgtatatgtaatggtagaaagtgtgtgcatatatagagtaagggtgcaaaaagggttaagtatcaaggtacaaagggaatctgtcagcattctctaaaaattaggaaacgacatctttcccaaacataaaaaggacagctgtccaatttctgtaccttcttaccacaaaaaatggacaattgtccaatttctgaatatttgagaccccctaatccttatcctttcctactcagattgtgacagttgtcccagttatagaaacttcctagtattcgctgaaaattttcaaattaaaaaccccaaaataacccttcaggattttgaaattgcctcagaaccaaatcaccttccccagtacttcttatgcatacctcgacctcttctaaatatctccatggccaacctctcagacctcctgacaggagcatcaatgcttcttctcttaacatgtccgaaccatttcagcctcgactcccgcatcttgtcttccatggatgccactcccactctatcccggatagcttcattcttaatcctatttctcctggtacacctgcacatccatctcaatattttcatctttgctactttcatttctgcacgtgagagttcttgactggccaacactcagcccctatagtatagccggtcaaaccaccactcgataaatcttacccttaagtcttggcgacacattcttatcacataaaacaccagaggtgagcctccacttcatctatcccgctctgatgtgatgtgtgatatcttcgtcaatctccctgttacctggataataacccgagatacttaaaacttgctctcttggggataacttgagcatcaagcttaacctctacgtcaatcataggcccgtcactgaatttgcactccaagtatttttcttggtttcactcagtttgaaacctttagactccaaggtctgtctccaaactccaacctcgcgttaactccgcttcgcgtccgtcaatcaacactatatattggcaaataatatgcaccaaggcacctcccctggatgtgtgcgacagtacatccatgccaaggcaaataaaaatgggctaagaatcgatccctggtgcaacccatctccacagggaaatctccgagtcaccacccacaatcctcacccagtcttagcatcattatatatatccttaatcactctaatgtacgctaccggaatgccactaacctccaaacacctccacaagacctccctcgggactttatcgtatgctttctcaaggtcaataaacacatatgcaaatcctttttccttccctgtacgctccattaatatccttaccagatgaatcgcttccttagtcgaatacaccacgcatgaatccatacacgcacctcctcaccctacctcaccaccctctcccaaacttcatagtgtgactcaacaacttgatacccttataattgttgcaatcttggatatcacccttgttcttgtaaagcggaaccatcgtacttcacttccattcttcgggcatcttcttcgtcttaaaaatagcattaaacagcccagtgagccactccaaacctgcccgccccgtgctcttccagaattccaccgggatttcgcctggcctcgtcgctctgcccctacacatcttacgcatcgcccttccacctcctataccataatccgcctacagtacccaaaatcccgccgactctcggagtgctccaactcacccagcacaatgcgtctacctccctcctcgtttaacagtttatgtaagtatgtctgtcatcttctcctaataagtacttcgtccatcaacactttgccatccgcattccttgatgcacttgacttggtctaaatcgccgggcttttctctccctcgtcttggccaaccagtacaacttcttgtccccgcctttgccccgagttcatcgtacagatgagcaaacgccgcatttttagtcgtcgcaactgctaacttcgcctctttctttacctttttgtaacactcccagtaagtctttttatcctcctcgtttgtactctccactagcttcaaataagcagcttcttaaattccactttaccttgaacctctccattccaccatcagtcccctttatgacctctagaagagcccttcgtgacccctaagacctctttagcagctaccctaatgcaatctgtagtcgtcaaccacatactagacgcgtcccccctactcatcgaggccctcatagttaccccacttgatcttaggtcgcctatgcaggttcatcaattcaaatgtgtttcgaaattgtagaaggcattaatttctgatccttacttaagaagaagcatctcaatcatgccaagaatgacagaaattctcaaaaacttcttattagccgaaagtgcattagtaaggatgatatgtgtagcttctattgttcttctttatcgtcacatcaacctgttgaggatgaacaaaaacttcattggccttcacactacaaacaaaagagttccttaattcactgttgctgtgatggggtggttcttctggcaattgttgatggattcgataaacaccttttgctgtggaacccttccacaagagaatcaatagaacttcccttcaagaatttccatttaaatatcctactggtattcactgtgtgtgtagtttaaagggtgtggactgagttgctcacaatttcttacttcgggtgagcattatgtggtgagcactttgtgcgcactgagtactctaactcttttagtagaaacttagattgatcgggtagaaaacgaaatgcaaaagccagacttttattactaaaattattgtacgacccctgataatgggctaaaacctcatctaagcagatacctttcttcatatcctttatcataccctcccaccaaggatgaaatgtgttcgaagaacgagaaaaaggaggcgtactgcttgagcaactaataggattctcaatcaacaaggtcaaaatgtaatatgtgtttatgtagctattgggcaaaaagcatcttccctgtataatagcctgcaaatcatatagagatgtaaattgcactaggcaagcactatacgagaaactcaaccgagaaagcattggaggggaattcgatctcatatcatccatatggatgacaaccctcaaaccaatgggaaacatttcaatgctaggaaagaaatgatttgaaggcccctctcttattacctattgttgcttttttagatgagagtacgagagtatatagtaattgctacgagtaatgcactgtttattcttcacatgtattttcggtggactgattccttgattaataatctactttttacaattattataaagggttggtcttttgagttgttcatgtgggctgtggctttagtgcaatgcacatctataaagaacataaataagatatttttacatacctatacactattggaaactttattgttattttctatatataaatttatcaattatatatactttaggaattaaatgagtaccactttatattaggaatcaattatttttcatccttattctctctccctcgttctctctctctctctctgcgctctttctctctctacgtctctctctctctctctctctctatatataatatatatgtctctctatctctcaatccctaattgcagtaaagtagagcaaaggaaagagagcaacaattccacctttgacaaccaatgaaaagctttgaagctttgaattcgaatttgagtttttcaaaaaatattatttgtttgaattgggtgttgttgcaaagaattgggaatttttttctacgtctctctgtctctcattccctaatttcagtaatgtaaagcaaaagaaaagatagcaacaatttcaccattaacatccattaaaaagttttgaagctttgaattcgaatttgggttttcaaaaatcattatttttttggattaggtgtgttacaagcaattatgaatatgatttggagtttatatctcaattttgaggtgttttggtgaagattagacttgatttttgctgaatttcagattaaactcagagaagaagacatgacatacattatgtttacgaaattatatatatataactattgcatgaaagtcgaacaatattgtatacaaattatatttaagtatatatatctgagtagaaataatataagatatgacatacattatgtttacgaatattatatatatacatatgaaagtcgaacaatattgtatacaaattatatttaaattatatatatctgagtagaaataatatatgaaaattgtagataagttgtagataagttatgtaatatataattagttgtatgaaatttatttcagatactaatatacaaaagacatattgtataaattttaaataaaatatgtatttaagttgtatgttattgcagttgtatttaactgggtaaaaataatgtttgaaagttgtagataagttgtataatatataattagttgtttgaaatttatttttactatgtataaatcaaatacaaaatatacaaaatacatgttgtataaattttgtatcaaaatgtgtgtttaagttgtatattatcgtagttgtatttaactggatagtgcacgaaaaaattcccatgaataagttgtgtgcatattaacaaattcataatatgttaacaaactgacaactgaataaattgtacagattttataaattcaaacctaacaaaaaaattactttgaattacagtctattaaccaaattctttagatccaattctgcgccttttcttttgtcccatataacattaaactgagctcattgatttaagacttgtgactatccatttattattcatgtcagaaagtgtttatccttttagaagactttctatttattatagtgcacgaaaaaactccattttctatttggtgctcatgtaggattgcatatagatgttcataacacgcagcggaagataataacaattctaggcagaacttttcgtgtttaaatttatttacatgtcaagaatggatctaagacgtacctggtgaagagagtcgtttcaaaattttcttcgatagtgcgaagactctatgcatatccacaccgagaccgatccttgctataaactctttgatcaacgaaacccgcaacaaattgaacgaagaatattgtgttgaaatttttctcaaaaatctcaactcaatgttagaagaacaagaaacatttttcttgtaattgtattttctctcttggctttgtattgcactctcactttcacaaagtgtttttcttctcaagaattttttatttgcaaattttctccatcacctttatatagcatcacctataaaccattttcctatttgattttggtaatgatttatttaaggtaaaagtttattcaaaaataaacttttatggatagaatcccatctcaatggaaagatgacattctcattaaatccaattcccagttggattacattgcccgtaagtcgtttcatggattttaaacgtaaaggtccaattttaaattggatatgatttaaaagtttctcattaatattttacatgcatatattatataagtgaatattatttatatatatatcacatatacattttaaccaagagatatattttaatttttattctaaatagaaaacttcaatttgtttacaatgttaattatattctctgtgctagcaaagaatataataatatttcatttggactaataactctatttgactaattaaattttttaatttaattatcaaacaattaagtaattaatcctttagcaaagatcagaacactcgttagtgtgcgaccccatagattcaatactaaaccggtagtaaattgatcatatcaatatactaatcaagagtggcgtctagcaacactccttaacggccggatagcatgaagtatacaatttactctcaagaaccaggtagaagaataatgtagtaattccttttgtccttatagctctggatcaccctaggatatggttcaactgtcaaattctaataggcgaccaactatgtattcatgtcaaatataatcgaccattgaatgacctaagaaactcttttattctttcattcaattgccctggccaaggtcttagtttggtcgtttataattcatgacaacatggagcttaaactcattactaagagttgacaaattccatcttgatcaatcactaattctacaagtatttaatcgtgttcaatatccttttaactatcgccctagggccataggtgtctagtataaaagcaaaattaaataacttgtcaattactatggcgatctcaggtcaaaggaaatttttacatcacattcttcaagagaatatcgtttgacagtttatggtaattctaaccattaggaattatccaatgagtcggttcaatatcatatccctatatgcatcatctacctatgtgatttagttaatgagatcaactaatctttatcacataaagacgatcacataaatattgatctaaccggattactaatgtccaaattaataatcttacgaccaagaacaaatttagattaaattataagaaacttcactttcattatcatgatctccatcacgatggtaagtctcaaaatttaatcaaggatcttattaaattaatcaaacaattaataacaactatgattaaagaatatcaaatgccatatattttatatcaaataatattcacaaaaatatgttcaaatcatcaaatatgacattgggcctagggcatatctactatatccctaacagctcactccttctaaactactcatgtgcaggtgctgtgatctgtccaaaatgtccaaaatgacttcaatagaagatagaataagagttatgcagcagataatcttcacgagaaatatctcttaatgatactttgaatttaaatgactttgggcaatgcgtacataaagatgaccggggagattcaaaaattagaagatgatttgtgagaaaacatatgagtagaaacataaagaaaagagaagaggagaaaaaaaaaggaaaagggtgcaactacgtccctatattaaaggcacaaataataaattgtgaactttttaaggtggattgtatatattttgtaaataaagcttgtttatgctggataattaactaaacatggacattaaggataataaagtttcaaatagtatatatgaatgaaaatccctttaaaataaaagggtattatcacttttaaccagcgccaaaaactatttgtattttggtagcccaaaaagtgtataaaatttgtataatcaaaatatcaatagattcattgattcctttcatcactctacaatctcaaaaactaagaattttattttaaaaattggctctgtttttaattcatttctattcacattcaatctactgtgtcgactcagtggcgatgtcactttttctctcttttgctcaatttttgtgctctgcactggaaaatttcagcttgatggtagtttttctgccgtatccgccgaagctcagagatcattgtgcattgtgtgtgttgtaaatgaattagtgggcgtttggacataagaattgtaaaattccaagaaaaagtgaaataaattttaagtgaaaatggatttgaaaattagagttgtatttgtacatgaatataattgtgggttattttgaatttttgcaagtgaagtgagtgaaaattttgaaaaatagtttttcggagtttttcaaattttcaaagaattctaaaaatttatcttcaactgaaaattgaaaattttatggccaaacactgatttcgaaaaaaaaataaaaaatttcggaaaaattaaaaaaattcctaggtcttacgggctctaaaatgtttagacattcttttatttctgcgaataaaagatatggaaaaaaaatcaacggaccaaagaataaaagagttcgtttaagaatttccttatgggccggaactgaatgcttctggacgagaaagggaagacacatgagaaataaagattttgttagaagactaacaaacgtcgtggtagagtgttaagtactctttcattattaatcattcgagtctttttgaatatgaagtcgtctttgttaggaagcgttttgtccacattggggacttcccgaagaaataaaaaaaaatttagagaaaaccgcatgttgtaagagattgcgctaaaaagatggacttctcctagcaaaaaaaacataatttcaacaacttagaaattgaaactaatgctactgaaatacccaattgcttccttataataattgttctctatattctaatctgattaatgagtgcaggttgttactaaaggagctggagaatccaataatccgacacaatttccgtaagaggaacagactcgtgcactttttggcaaagagagggtccaagcaatatccccttatcaacaatgcttcatccaccaaatgtttgttggaaactgctccacgacgacaaagctgggacaactactactaaattagtatgtaccaatgtattaaacaaactaaccgagcttgagaacattaatcgttttgtaatatggctagcagggctcctggcttaggtgtttggagtgcccctactgtggcaccatcgatatgtaatagtactacttaattattaatataaatttcgtcgttctagacagacgggcaataaatatgtacaaagggttggataaactcgtaaaatatatgttcctcggaaaaaatacaatgtgaaactagattaatatatacagtaaaaaaaaattatatctcatttaacatattttgcaggtaatggtttctgtagataaattgatgtgtcattatttgagttttaagcaattcatagcgcaattcaaaattgaccaacagtaataacaacataataaatgtttggagaatagaataaaattttaaatattgtctgaaagtagtgtataatgcaattatatcctttttagtctgtttcaaaacggatgaacacgttcgtgtatttatttaatgagaagtagcagaatgatttaaagaattttcgaccaattgacctttataatactatttataagattattacaaaaaatattgttaatcatataaaacttattatgtacaaactcattaatccatgccaatctagtttcttaaatggcagacctacgtgtgacaatgccataattattcaagaaattatctactatttcgatagattaaaaggctagaaaagaaaattcatcattgagattgatttagaaaaaaaaaatcgatagattagaatggttctttttctgtagagcttcaagttcatcccaatatcataaaatatttctttttttaatttttcatctggtgtccgatatttatattgcggcccgactaattcagattcacgctgaaaagttccaaattgagggctaaagcgttccctaaaaaaaagcgattccatacccagaggttcaaactcgagatctctgattaaggatagagtatttaccactctaccacaacccttattggtatagtaaaactaataacatattcattcttattaatggatctgctacaatattttttcaaccgactagatgcatccgtcgaggagatcccatgcccctacctatttatcttctgtctaggattactatttatcttttttcttaaatttttgtccttttcccttaaatttgcatccgtttgtaaaaccgatatatgaactcttgggtttttcatttgaacacctttacttgaaaacatgactactaataagcacttgtgatagtgcgtgttgctcaatcgttgctgacatggatttaatttaatattttgtatagccacatcgttcattcagtcatattttgttgacacgtgtatgttcaaatttaattagcctcctgtaattatagccaaattacattccttctcatacatctcatcccaaattctcacggtagcctcgctggaactccgacgggttcttctccaagcttattgccaaaacccccaaaataatggacgatagctaaaagcaacttgaaactcattgccgaacaaaacaaagaccaaaaaaaagaagggaagagaaagagtaaaaatagggaataagatagcgaaaatgacacaagcgtcagcgatggagtactacctccatgacttgccgtcgtcatataatctggtgcttaaggaagttctaggtcgaggtcgctttttgaaatcaattttgtgtaaacacaacgaaggactcgtgctcgtaaaggtctatttcaaaagaggcgatttcattgatttgcgagattacgagcagcgtctctccaaaatccgtgacatcttcacctcccttgatcatccacatgtttggcctttccaggtttggtagtctcttcactaaattttggcttattgactttgaattttgaaggagaagacgacagaggtaggagcgaagggaatttagaaggggaaagggattttcctgtgccatttgtattttattccggttctcgttttttttaaaataaaaacaatattatccacgcgcttttagtacataatttagctatgtcagctgcatcgcttccacataaatatagttaacggtcaaatatatttgttagtattcattacatcaagttaaagtgttcaaatagaaaaagtgcaagtttatgtagggcactcctatatttttatatcaaattattttcattttacttttttctataatttttttatttatttccttctcaaatatctaacagcattaagcattttcttctccctttccaaaattaataatctatctatatatcttctatatatctatatgtcactttcattgactaagaaattaatttatctaatttcttattttttggggttttgcctcatttttctttaaaaagaaaaaattaaaccattcggttataactccaacaattaacagtcactaacattttatttcctagctagcaatcacgaaattaaatgataaggtctttttttcaatttaaatattagtaatttttagtttattctttatcaatcaaagaatgcttttttcctttttttcttatttattctttctcaactaaggaatgctatttttatttttttcttattcttttgccttttctttcattttataataataatttgttgtgttttattaaaaaattcaaatggtactttattaatcctcgtaccccttatttggatggttgttacccatcatttcataatttatcatatcgtattgtattgtattattttgtggatacaatgtttggatagattgtatcgttttattatttagtttgattgtatggtaatgtactgtaactgataatttactaaaacacccttagttgcagtaaagtttagattttatcaataataactcataaagtagtttaagataattgctttcgactaatttaccacaattatgtgtatatatatatatatatatatatatatataatatatatatatatatattattcaaattcatacaaattctagtgaagttactaaaaaaaataagttttgtttttataagaaaagaacgtaggcttgatcagccaaaaacgttgagtagaacaatggaaacaaaaccagaaacctaattaaagaaaaagttaacaattattagcaataaaaaaagtagaacaatggaagaaccataataaacaaaagtggtagaactaatcaaaatcttacgggaaaatgaacgaaaagagtaggtttagcttggacttggagttaaaataataaaataagaaaaaggataatgtaggattaataagtaagggtatagttggaaagaaaaatacgtaacaatccgaccacaccaaatcggtcgttatataaaatggctcttttcgttgttacgtaacaatggatttaacaatacaatacaacggattttaagtaacaatcaaaacaaacattataattataataattatacgatacgatacgatacgacggtaacaaccatccaaacaaagggttattcactcctatttcaaaagactctttcttaatccttttaattgcaccttccgctcttccgtttgtaacttcgtataccatatgtatttattatgcttaaatttgtatcattatattattcttagtaatattattatattatattgttcactagtgcaaaataattctttataaaggcatatcagacttttagatatcacaagttcattttgcataagatttgtctgaagacaactttcattaaaatataaaatattgtaaagtactgtcacgtttaaaaatccaaatttattccaccttactctcggaaatgctagaaattttcggtaatgaacgtaaaaattagatttttgaggggtaacacgaagcagaaatatccaaaggtaatatgcacttgccaaaatggcgaaaagagtacatgatttttgataaaaagcattattactatctctttttttactttctttgtgttaaaaatgaaattttattgctcatacatgattttcttgataatataattattaacataaaagaaatatggtaaactattctcaaagtattctcatactttgatgtcctcgaatattttattttaattatctatatatctatatctatatatatatatataataaagctgggaataagagtaacgacttggcacttcttttaggccaggaaatttatttatcttttttcttattttctttgctttttttattttcctattcaattgtttaggcctttctaatcattaaattgaattgaattgaatgatgcaataaaaaaaaggaagtgattgatccctcatgtctcttatgttaagaattattatatatataaaagttatatgatagtcatacaccaccataaaagccgtttttaataaaaaagagaattttaattatatcagtaaatgcataataattaaatagtctgtccatgaaagctgcagatgccttattatgatttatgaatagttatgccggaatatcttattaaaagttattattttttgttacctaatattgaaaacaaaacgcaaaaatacttttatcataattctttaaatatttatcaaataaaataaattaaaaattaattcttttggtctttgagaatttttggtaaaaattgatagtgggatgtaaattttaaagaataatatatattttataataaataacttaatattaaaaatacctagtttgtatattttttcttctactattttatttctaattgttccaaatttttatttttaccgatttgaatcttaattttaatttcttttatcgctaacatcgcatatttattgacaatggtaaaattatctttttctataaaaagtggcttttattgtagtgtatgacttcggagaagtaaatgaatagttatttttttttttcctaaaacaaagaaaagtaattttgctaggaaaatcaccaagttaattgactttttgagaaattaactctatgtatatgcaaattttatcttgtattgatttttattttttttttaaaaaagagttatatttctttatgccacgcgaagggataaaattactagttttatatagttcaggtaatattgaccccttttttttgtataaattatattctgaaatttcatctgactacaatttgtatatctcatcatattttcttaatttacaataaaataattattattaaacttaggcaaattaagctcctatatgtgttgctcttggttcttctgcttttttatttgcttttttaattttaagggatttaatttatatttttcctatgttgaatttttgtaaatttatttggattgtcgttaaagttttagccaatttatgatagtaaattttgtatgtcctattattttttgtttctttaaaggaaataaagtcaaatatcgtcctcattcaattaagagcgacaattagaattaatcttttagaaaattttgtttttttttttttcgaaatcggtgtttggccataaattttaattttcattttaagatgaattttgaaatttttttaaaatttgaaaacttcaaaaagatatttttcaaaattttcactcagaccacttacaaaaattcaaaaacaacaatgacccaataaaatcccgctaatggtatctgaagagggtagtgtatacgcagattttatccctattcgaggaatagagaggcttcacaaaaattcaaaaataaaccaaaattatattaatatccaaacaaaactctaattttcaaataatatttttatttttattttcgaaattttacaattctaacgcccacatatactaaaggcatcttatttccaagcaaaactttagttattagaaaataattaagtatagctgctttggtcaaacgcaaataaaaatagtgaatatattattatatgtccacactcttgcactctccgcattaaaacttgtaccttctaattcctttcttcttcctcactctctccgtcagtcacttaaaaccctagcctccccgaaatccccaaatcactccaattctttatctaagccctagcaatggaagacgtctgcgaaggcaaagatttcagctttccaaatcaagaagagaaaattctccaatggtggattcagtaaaagcattcgaaacccagctcgaaaaaaccaaaaatcaacccgaatacatcttctacgacgggccgccatttgcgacgggtttgccgcattacgggcatattttagcgggtacaattaaggatattgtgacccggtatcaatccatgacgggtcatcatgtgacccgaagattcggttgggattgtcatggattaccagttgaacatgagattgacgagaaacttgagattaagactaaacaacaagtgattgacatggggattgataagtataacgaagaatgtagagctattgttacgaggtatgttggggaatgggagaagacagtggtgagaatggggaggtggattgattttaagaatgggtacaagactatggatttgaagttcatggaaagtgtttggtgggtttttgctcagttgtttcaaaagggtcttgtttatagaggtttcaaggtttgtcctttttcatctttcttgaacttgtattataatttaaaatgatgcttgatataagcagtatatttttgatttaaaaaaaagaacaagttgcagagttttgggattgaggcaaagttgtagtaattgtagtagtagttccgtaaattgtgttttctacctgtccgaattagtttgtgttagcttaattagtccaccgcaagcatggtaagattaatactagcttgattaatatcaagtgttttgtgggtttttgctcagttgtttcagaagggtcttgtttatagaggtttcatggtttgttatttttcttattcgtcaacttgtagcacaattcagaatgatccttgattagaaaatttgcattaatagaaaaagtaatctagaagaacaatttgttgattactctgcctaagccttggtgggcggagttaaccggtcaacagtagcaagtaactaaggaattagtaagaattggttgagatcacaagctggcatgaacaccattaccattaaaaatagaaaatctaaaagaataatatgttgcgcatttggattgaggcaaagttgttgttgtgcttttcttaaactgtgttgtccaattgtcgggcctagttttgtgctagctcgattaatccatccacaagcatgctaaactaataggggtgccaggtaaacctgtcccaagaatggagcagattgactcatgtcgatatggttgggtttgaaagaaacttgactcttttcctgatttttctttttgcaggtcatgccttatagtactggtttgaagactccattatccaattttgaagctaattctaattataaggtctgtaatagaaatcatttagcagtttactaagtgcaatcctttttttctcttgttctggtgatgtcttatttatgtgattttttcgggtgtggtgcaggaagtaagtgaccctgaaatcatggtttccttcccgatagttgatgatccgagggggcgtcctttgttgcatggacaacaactccttggacccttcctagtaatcttgctctttgtgtcaacgccaattttgtatatgtcaaggttagtccttagtaaaacttctggtttgaaatctaagtgaattgttgctttaattggattactgtaaattgggagtccgaagggcttgtttttactttaacttttatagtgcttcaaacacggttagtattgttgttacaaagtcaaaggtcttcggttcttgttaatttcttgctctgagatgtatcaattgtactgctagttcattacatttaattaaattgtacatttgatgattacattcatttaattggagtgtacaagtctagcgaaaatggtatttattcagtttacgtaaagaaggacacattatatttgtttcttattggtatgtaataggtttgtagatctggaaatatttgctttcgtctaagcttgttaatgttgatttgataataacgatcaggttcgcaacaaattcaatgggaagatttatgtggtggcagaatctcgattgccgagctgccagttgagaaggcgaaaaaggtcaccccaaatggacctgctgccgacactcaaaatccaaattctaagtcaaagccttctggtggtaaatcacagaatgtcgaaacttatgaggtggtggataaattctctggatcgtcccttgtggggaagaagtgagcaattttcttcttgaactttgtcattgatatgctgcacaaagttttctgttcttgatgtctgcaatatggtagctagtgacttgaatgaaagttgataaaaagtgatccttcatctttacgttctgatttaaggttaatttgatttacatgtcttctgtcttgtatactgattcatatttgacctgactcatatgctacacactgtaaataaaagccgattattggtagttgttttaggtttattggtttgttttcgttgaacatgtttaatgactttaccagctatgactccaattattcgagccccttgaaaggtcaatctttgatgcctttattttggaatcgtctttgttcaaataagatctctcccttgttctgcctcttctatgatcttgaccttgccaacacgtagaattttgatagattgttgactgtatggatgtatttgcttcttatcattttttgtaaaaaattagcagcctagcaggtattacttcacacctctctacctcctcttataggagagtcttctatgtgtatgataccaagtgttttcttttgttttttgcttgtaatattggatttgcctaattaggaaaataaccttactctgaaatatgaaaagaaaagaaaaatcaaaagcgagattgtcaaagacaagggatgtcgtcaaatgaagcacttctttttcttttttcttcttttttcacgtgaaggaaggaacaggcaattactttcagttaagagttgaactcaattgtcaaatgaagtagtgttgtgcatgctaggatgcgtgtgtgtgtctgtgttatcttatttttaggatcctttccatcagttacgtgcgttgttcccttttgctgctgctttttgtgtgtagaaatggggaaggtgatgagtactatagtggtaatctctttcttagaagatgcaaaatggtatttcttggcaatgacctgcttacccccctccaaccagtccccaacagccttttctctattttggtgggtggatggatcagatggtgattgattgattgattgggtggttaggtggtctcatagcatgaatttttttcgggcatggcagagttcacttaatttaagctagaaagatagaggcaagaaatcagagaaagtagctatagtggaagggcttatacgcattgcgtaagtgctggtctttatggatttgaaccatatagctctgaaaattttggtattttcttttacctcgacctctgacctcttatcttgacccagcgtgttctcttgtattttaagcaccaacatcgtcttgttttctagtacatgtgtccatttagttggaatggatatgaatcccttcccacatttaaggtttttctgtttttcttttgcatgtgagctaatgatcgggtcagtggtgaacttagcgttaaatgccagtactgactttcaaggttgacttttatcaagaaaggttgacatgtagatattcaatgcaggtatattccactatttgattacttcaaggattttctgacacagcaattcagagtcgttgcggatgattatgtgacttctgacagtggtactggaattgttcattgtgctcccgcctttggtgaggacgattatcgtgtttgtattggaaatcacataatcaaaaaggttcgaaaacttatggaacttcatagtatttctgcaatgattcctattgcctgtaatagaatacatatttcattttctgtcatctgtatatttgctatggaacttatacgttatgttattagcttttggccgtttagtacgttcttacaagtttcaggatctgcacgaatttactacttttacttttcgatgcagtatctgacttggcgctcctttcttcctgggaaaatgtactggaataacgtctgggggcttgttaaaatattaggagctgattctgcttgtttacttcaacctttagatggtctctcttaccaccccttttcataaccacttagtatctagattttcatgtttctcttgctgaaggaagtacagtgtggattacagcatttttcttgccctttatttgcaacatatggcatactttgtacgtacaagcctttcccccaaatgtttgactaaatcagtccttctttggtttgttgttttaataatattgtgactttgagctctttcgagaattattagattccaagtttaccattatattactccgatgaaattgatttagttggattttgttttctgtagggggagagcctgattgtggcggtagatgataatggctactttactgatagaattacagacttcagaggaaaatatgttaaggaggcagataatgatatcactcaagcagtgaaggcaagagactctaatactcctcttctttttgtggcactataatgtatgtgtctttaatttttacgaacacggggtggagataccttctctctctcaacaaaaaaaaaaaagaaaagaaaaagaaaaaagattatgacaattttctgaataaaattggctgccaacggccatcataaagaatatgatttaccataaactttgtaggtagcttgccttttacctgagtgaggaaatgttgtttgtttgtttatggttttttatatctatggtcgtttatttagttttgattgattaccatgcttaagatacttttgtttttaggagaaaggaaggcttgtcaaatctggaagtttatcacatcctttttgctggagatctgacacacctctgatttacaagcagttcctagctggtaacatacatcagatcattccgtgcatcaaacactgttacgatcctttattttctattgtcttatgatgcagtatttatttagtcctttgagattatgaccatttggaatgagaatgagcttgtttgttttctttccctatgcatagcttttctcctttttggcctttctaatctcagtgtaacttacataagattgatgcatcattgcgagtggttgggattggtttattaaaggatattggtccacgaaaatccagctggtgtcgattccttaactttctttattgcactgcttggtttgtcagtagtcgttttgtgttaaatgagtattgtggaactgtaaccttgatgtttgtcgaataaaatagaaacacatcctttttttagtagattacaatcgacatgaaaacccatgtccaaaacttggtgagtactttcctcttatagtagtcttatttttactttttattaatctcttctatggaacatcaaccaagtttatttttgataaagatcatcaaccaagatttttatcaggtgttcagtttcttttcaactgtaatataagatatcctagaagctctgccattcttcacgagtaatagttctctaatataaagttttgactatcatcgaatgttggtggtaccagctcgacctctcctattggttgattgtgtagctaatacaatctagtccttggagaagtactgaactgtcctacatctactcggaaggctatcattaagaaaaaacctaatgtttagaaggaaaactatgtctgtaacctcttaaggttacaaacataatgttcacaagatgaaaataattttagcaattacatgcatttagagttttgtaagctatgccataatgaattgatatttataaaccatacgttttaattgtggttaattttgtaaaaagaggtgaaccgatcttgataatgagttgtcacttcgaagggaagtaaaagagggagttttgagtttcaagcttcgccttttttggatggaaaagaggaggttgtaatgcaaagtacatatgttattgtattgcattcattcttcttgcaatgcaagtgagagaagatggatagtgacttattcagatatactggaaggattggcaagagagtgatagcctagtggaaatggctctccaacttgaatgatcagtttgggtgttcgaatcaccgagggagcaagttggaaaaaaccactgtttggttcctggggtatttaccatatataagaaaaaagagaccggaaagatcatctacagttcaagcacctaaagcatgctttggcccatctatatgttattaagcactgttttcatttttgtgtatttgtgaattctttttaacgtcttcttttctcttgattatttgctgggttgttttctctgattcatgacaattaaaaattcatgaatcttatcagcacctaacattgcatattgcattttggcaagtcttttttaatgttctttttgtttttcttgtaatgcttttttctctttttgatgaccaacaatgtttattttctcttttgctgtcatgcatctattaacctctgtattaatgttttttggaatggtattcttggtttacgtatggccaggtttattatggtggaaaagattaaggatcaattgctagagaacaataaacaaacctactgggttcctgattttgtgaaggttactatttcctttctgcctttagctttcttgttggctaattcaataaaaaagttccgtgttcgcagtaaatgaaatttgactgctgatttgttttgttgtactgtttgagttggttctgcttatgtattgtcaggccttattcattgtttactccaccacatgctagctgctgccttaccctcggaaaaaccttttaatttactccattttggtctctctgtttttactttgtttttaggagttattggagtttactacaaaatacttgctggtaaagatgctcatggaacaaccttcatatgagattagacctttagggatatgcacatgttttgaattgttgtaatatataagaaaattaatgtttcacaaggtgagttgggacttgtcccagtagtgtgaggcaggctgggctagtgccctaataggaataccccaacatgctttacttcgattgtttgccttgtacacctagaatattttcatttgaaattttcttttaagggttaactctaactaatatagtgttttttagttctagcattttggatttggttgttttgtttattgttttagggtatgtatgccattctgcctagatgttaaatttgttttatagatttttttccttttgaattttgttcaaatctatattgcaaggactctccaaaagcagccgcatccgtgtcggtacttaaaaaaatgcaatacttttggaggatccgacacgtatccggccatattttcggagagtccgagcaacataggttcaaatttgaatgtattctttattgtaaaaaatttatgttttaaaatattaaaacatggaagtttcattgggcttatgctccatggcacttaagcaaagcatttcttgccgcacctccgccttttaaatacagagaaaacaacaacccagtaaaattccatagtggggtttggggagggcttttaaatacagagtaaaattactattttaaactccacattctgcagtccaatatgatggattacaacactgctgacctggtattttgtcagtaacattctactttagtggagataggtcaggttttagctatcatccatttttgttgaagatcaggtgctttttcaggtttgacttgtgggagttaggtttcatatactttctaattcactgaagctttgcagaatatgaatgataactgacttttcatcaacagctcatgtttgttagaattttagaaattgtcagaacccaatagttcatcctgatcttagttttattttgtgttctgtatttcaggaaaaacgctttcacaattggttagaaaatgcaagggactgggctgttagccgaagtaggttctggggtactcctcttcctgtgtggattagcgaggatggtgaggagatagttgttatggactccattgacaaactggaaaagctttctggtgctaaggttctgccttcattaccgacattttgtaatacttgttttagtttcagcattctatgtttatgaccgtcttattattcactttatttttttatgaagtcgcctcttaacttcaacggctttcctcttgctcaatttgcaggtgacagacttgcatcgtcacaacattgatcacattacaattccgtccagtcgggggcctgaattcggcgttcttcgacgtgtggaggatgtaagaccagttaatctgttatttagcagtaggctaccacagcattaatatcacatttgatgtatctatcagacccaagtatttctgacagatatattttattgttatttgtttctttgtactgaagaggctgaatgaatttgtgaattaatggtttttttcttttgggataaaagcgtaaataaaggatttcacatatttgcccattcaacgagttagaaagaaaagaatgagttagaaaggcagtttgagtccattttgatttaatgctgattctgtttgctggaatattggttctcgtgttaaacctctggattattgatattgaattggataagatcgtaattgttgattcagggctgtatgcgaaaaatcaagaaaattgaactctatttttactgaagtgtgcgttattgctttttgctgctcagtcttgtctacattctcatggtgttatttgttcaatctttgagaaattttgagttgtcattgattgtcagaattatgtgttttacacattttgattgtgaaaagaatcaagaaaaaagatcttttccaggaagattgaatttttcatgtatcattgggttgtcaagagagcaataatgattcatatttggaacaaacgggtttctgctgccccagggctctgactgccacttaaaagattttctctatttttgttttttggttctgagctcgtcttttactccttgttgtttgaggtgctgtgtgcctgttgctggctgatactgtgcatcgctccacttatctaaatagaaattcttttttaggaactaataatttacaatgttttgcaagcggaaaatcaattgtactactctggagtatttatattataattgaactgcctgcttaggcactcaggcctaatggttcaatgaaatctccacatttaatgccctctctttttcaaactttttgaatgagcttgtacctttcaatagtttcttttcgattttgtgttctgctttgtgacaaaactatttgttgtatttatccaggtatttgattgctggtttgagagtgggtcaatgccttatgcttatatccactatccttttgagaatgttgaactcttcgagagcaatttccctggtcattttgtggcagaaggtcttgatcaaactcgtggatggtatgcatattctgattatgttctctatcattttgaccatgaattttctgaatacggaccccagccagaactttccccatcatcattcttcctataaatatgtaaccctagggaagatattgactgttggattatggtttcagttggcttcttctagagataatgcttgttgcaataaattccatgagcttattcctgctggaccctcagattggagattttcgattgccaacattcttgtccttagtcggtaccaccaagaattagatgaaatgaggatatgatacattttgatagacgttaaatagttgacttttgctagtattcaagttaaatcagtatgcacgtctgatactttttgattcttggtgctatatatattcttttattcttgttaaaaaagagtgtttcttacctatcaagaaataaaggagagacagtttctctgattcgtgtgtgtgtgtgtatatatatagagagagagaggtggtgatggtggtgcaaagttgaacgaactgcccttttttgccctttaaccttttattctatattaatattgtttctcattcttgttggcgagtgcagtggtcaagtgcccttatgctctcgattttagcttaaaaatttcacctctttttatgctgcgagaattattgccaagtttattgtttctgatgtcctgatgtcatcgctgctgtgaacatagttatgttcatgttttccaagtcagagaagacagaaaattcaaatagtggaatctataaggttcttatgtattgcaggttctacacccttatggtcctttctactgccctttttgggaaacctgcttttagaaatctcatttgcaatggtcttgtcctggctgaggatgggaagaagatgagtaaacgattaaagaactatcctcaaccatcagaagttatcaatgattatggagctgtaagttgtgccaatcatgagcttcttcattttcttagttgtgccaatcatgagcttcttcaatacataagaaccttatagattccactatatgtggtgctctgctcttctgattgatgggttgttagtgaaagtctagaacttatgtttgtgcaggatgcattacgtttatacctgataaactctcccgttgtccgtgctgaacctctgcgttttaagaaagacggagtttttgctgtggtaatgtatatcctttacatatggtggcactcaatctctatgattttaatcagtttttgtagtaactattttggaaaagcttttaaattgttttctccaaatttgaaagatgatgatattaatgcaggtgaaagatgttttcttgccatggtacaatgcatataggttccttgttcagaatgcaaaaagacttgaaattgatgggtttggaccattcattcccactgatcagaaaactttgcagagttcatccaatgtcctagatcaatggatcaattctgcaactcagagcttagtgcatttcgtccggcaggaaatggatgcttatagattgtacacggttagttttccgatcttatcgagtatcgaatctaaactcacattctcaacaatttcctgggtgcttactgaaactctgataatcttatccaagatgccttgaaagcggattcctgcaaatgtttgtgttgaaacctatcgatgtctgaacaagcttaaccatatttttgtatttcatttgaatgctcagacatttctcagatttttctgtggttaaagctggagactcgccaaataggcacgaacggtctctttgttgaaatttatgatctgcaagttcttcacgtctatagttaaagatggaaacctagcagatgggaacacatggtttctttgtcgaactgtgtggttataggatatctctagtttgcaagtacatgagattagagaatccatgttaatgttctgtctatcctctctttgcaggtggttccgtatctcctaaaatttcttgataatttaacgaatatctatgtgcggttcaatcggaagaggctaaaaggccgtactggtgagggggactgcagaactgctctttcaactctgtactatgtaagcttccatctcatactgttttcgtagatcttgagcttcacatgttgttagtgtctgtagggatctgtgcctgattctgttcgaagattcaacatttactcttccttgttaagtttcttttgtgaccgaatcgatgtagcatgacacattagtatggaagaaatatgtgatgaatcagactcatagttatggtacttgatgcaattcatatgaatattgaggccaaggcttttgaagcccactctcaactcgcagcaagaagtagcttctttcttttgttgtgcctttaatactttcatcccgctatgaattggagctgttctgctagtgctttctaacacattaagtcttcaatatgataggtgcttttgacttcatgtaaagcaatggcaccgttaactccttttttcactgaggttctttaccaaaacttgcggaaagtttgcaaaggatcagaggagagcattcactattgcagctatcctgaagtggaaggaaaggtacatatgatttcctaccttttcttgccgttcatcaaatatgaagtgcagagttttgctatcttctctggctcaagtttgtttcatgaatgtttaaaatcattttagaggtgggagcgtattgagcagagtgttaataggatgatgacaattattgaccttgcacggaatattcgtgagcgtcacaataagcctcttaaaactccgctcaggttgagcctctgcacttttctctttccccaccccacagaacaaaaagcaaaagttcatgttggtcttgatcttctttcagggaaatggtggttgtgcatccagattcagaatttcttgatgatatcgcgggcaaacttagagaggtcagtgacggtcttagctttacatgcattttcattctgatgcctttaaactgttaattaaacaattattctattactataatcattgtttcattaatcctatttagttaattaatatattaatgtgataaagtcggagcacacttgagagttaattctaggtttattaaccaaaagcagttccacatttatactttaagtgaattttttgtgcaatttgatatctacaatgtttaattaaatataacaagcacattgagtataccaaatgaaccaatagtgagttgcacgcccaagttcttgttttccgttgtcggttgttttttctgaagataagggtaatttggtcacagaaaggtgtttcatgtttggttttatttccaccagtaatcatttttattttagttaaagttcagcattaaaacgaaatgaatcttggctagttaaggtattctgaaacaaactttctcaaaagaggaataatatggaattcagaggtgcaggtgaggtaggttggaaaatggagaaacggaacaatttgggagttggaggatggataggctgctggagtggaagtgctaaaagcagagtgtgtaacctatcccggcttactgtcccacttaacatacgtgtgggggctgggaaatgatgtttttggggatgggttgcatatggtggtttaacagtgctgctaaaggaacttattagatgtaacattaagccctaaaactaggtgcagcatacgggaagcgcttctcctcactaggtagcaatactctaatgttattgaagaatgttagtgattaggaaaggaagcagaaatttttgatccgtcttgcatgaaaacaattgggttttttcttagaaagttgccactcctattgtcttttgtttttgtctctccgaaaccaatttttttaattttttttgctttggcaacccctgaataggacgtttgtcaattttcagattttggaaatatgcacttattcgccaaaaggcaataacagataagcataaaaaggtttaggctttttgtgatatacgttagcaataaccacttctctcaaacagcaacataactactgatatgcctcaatgtcaagcttgtaggagccaattcatgaatcctctatatccattctgctttatatgggcttatgtacctacctgtttattgttgaggcttcaagtgtttatgttggaatcagtttccttcctgattgatgacttcctgtctcaggttgatttatttgtcttttttaggacccatctaaagaaaaattttctacagttgcactttgcagtaatttagttgtatacttgtatttactaagggcctctgtggtttgggtttggtacccattttgataagtttatctgataaattgggttccttattcacaataaactttggctgatgaagatgaagtcctactttttgagctgctgactctcacttcaacaaaatgagtatctgatcaattatctaatatcaacatttagagtaatgatgtataattatcataaacctgaccaaatggctattttcctgcgttagtataattatgttcgtttttttttactttgtgtttttgtattatgtatcttgtttaatttttaatggttggttcttttgtgatgcagtttgtgctcgaggagctaaacatcaagtctttggtcccatgcaatgacacgttgaagtatgcttctttgcgtgcagagccagatttcaggtgatctagatgtcatgtgtcaagtttgtcttcatttgttgttctctgaattaacctcattcaactggtccttcctcagtgtgttaggaaaaaggctgggaaagtcgatgggagttgttttccaaggaagttaaggccatgtcaacagaagatattattgcttttgagaaagcgggagaaattactgtcgcttcaaacactttgaagcttagtgatatcaaggtgaatatgatttttgatagtctttactcgcttcttttaaattcctcatatttgccagtcgccaccctaaaaagatctgttctgctatgggttttcttttgttgggtataccgaaactggggacaaaggtagagtaggtcaattgcctgtcaggaccagaaatgaaggaaaaagtggcaactgaagaagcaaagattcctttaaaatttatgctgccccaagttagtaattcatagataggttaatatgttattctgtacttcggctcagtagcttcaggtaggtacattgagtcttgagaaatgttttctttatgatcataggaagtgctttactttggttcatgtgaaaacctttgtctgttcaaggaaacctcaaggagaagtcttgagtaagggctgtttttgctgtccatggtggttgttgaaaaagaagatgaaagctgaaagtcaaaatatctttaagatagaggttttatatttcaaagttgatctagttctatttttaaggaagaggattaaagaacctgatcctaaatattctggactcctaattcttgtcattgaataaagtagtaaaactttgaaataaaatatctatagaaagtaccaaatagttatgaattttggatgctacaacagacaagtgcaatattaatttgaagaaggagtttaggttttgaaaaagttcgatttattttgctcatcttaatattcaaaattttctgggaaaaggtttcattgcttattgtgacctctggcactgcatcaaacgcttgaactattattattattatgatgagtattctttagtattattattactattactattattactattatcagtattattttggataagatctttaatgtacttgtagattgttcgaggtttcaaacgtcctgataataggaaagagaatgaaatggatgcggcagggatggtgagcatctcctccttcacgagtttagtatttatgtttcatctgatttcttatagttttattcatttgttgcacatacaggtgatgttttagtgatactggatttgcgtactgatgattcactgtttgaggctggagttgctcgggaggtattccgaagtattcccaatgcgattaatggcagatattatcgagtttttacttgtattttgattgattactgttgtgttgggagattcctgatgagtggctttcatgccgaactctgcttgcaggttgtgaataggatacagaaactgagaaagaaagccgcgcttgaacccactgatttggtagaggtcttcttcaaatttggattgaggataaaactgtctctcagcagattttggagtcccaggtaacttttgaggtccacagtattacttggtgtttcctattttttaggtacctggctctgtgatatctgcccttcttgatagagaagatctagagtctgaaaacttaaatttcatatgctcaaatttatagttccttaagaagagaactaatctatttttgaggctgaaagggttatttaacggaaatttgaagttccaggggatggcaatcattaaatgttggagcccagaggggctttttcacttctgcaaaaaataattatccatgtacctcaatgttcttcaggaagcggtttctgtggactttaagatctgattatgaagagtcttgtgtttctgtcttatatgttgggcttactcagccatattctacatatttcttttttgattcttttgcacaaatttctgattacctttactgagtagctcagtgcccatcagtatttagaggctggtgcatgcttgcttctattgccaaaacctaacttgtttgtctcttcctttctccgcctttttttttggcgttacaggaacaatatattagagatgcccttgggtctcctttgcttcctgccgacctgatcccatcacatgcagtaagttctgtctcctcttcctcgtttaggtctttgtgagctctatccaagtgtaccatttctctgtgtattaatatttagagctggtttctcccttgaattcaactcttacaattagattgaaaaaaagtcgcttatgaaatattattgtagttttttgtacaccggttaacaagtttggtaagttgcagatgacaattggtgaagagagtttccatggaatctccagcttgtcgtttgtgattacgttagcaagaccaagtctagtgtttaattcagatgccatcactgctttatatggagttgaatttgagattcttgtttcgggaattttggtgattttgaggttgttttctgtttctaaactatcttcatcttgcaggaaacacacagtattctcaaggcttacaaacttacctcgatgaggatcaccataacttgaagtcagagtttcaacaaggaaagggcaaggtttgtaccacaaaaccttcataatgctaaattatatgatctcatctaaaaacttagacggtcacaaatttcaacttggtattagtgcacgcttttaatcacttcattatattatgtctctatacgccttgtgatattttatgatgaatcctatgatgtctaattaatcatatttactttataattaaaacatgtacttttgattcctccacttgtgaatctcaacaagttaacactggtaatgttaaaacatttatctacccgtacgttttattattgtcaatatatgatatttttatataaaggaacaaaaagcacatacattaattaattaatatgtaaatattcttaaatattgaaagaatgaagatcaaagttttttctatttctcacttgatactcggtactttttttgaggaccgtttattgactaattcagtcgacttaagagctaaaatagtccatatcaaatgcaactttattttcaagctttgtctcatcagacttatcgaagaagtactaatcaccccactaaaatcttgatgaaaaattaaaaatcactcaataatttaaggaccaaaagacaagctcatacgcttcctcatgtatgagcctgtcttttttaatgggcaaaacacttggataatatgtcatgggtgagatttggaacccatgacatattgcttttgcgctgatagtatgttgaattgtgtctatcttgaattgtgaagctttttagatgacatggccacacaattcaacacataagtcagctagagttcctgcccatgacatattgcttttgcgctgatagtatgtcgaattgtgtctatcttgaatggtgaagcttttagatgacatggtcacacaattcaacacataagtcagctagagttcctgcgttttacgtagcgaatgatataattcttgacaccacttgttctgactttgcagataatggtcaagtgcattgagaatcagccttcagttgaggtggttctgggaaagcatgtcttcttgagtgttggagattatttcttgaacaggaaatcacagtaacagagactaatactctgccaatataatttttgacctgagaaatccaaagttacaaattttcccaattttttttttaaaaattattgtgcatttgcctcatccctgcatacttctattgcaacagatctgtaatgtaattgccttctgggccattttaacaaggaatagtgtaattggtgaaaaacaattttgattaattaagtgtcttctgattggtgttaactaatatgtacaagtttttcatgctcttaacttagttgaactaattttctactagaggtatgttcgatatgtttcatattaagtaacacgttctatcggggtaatatttgttagcaaatcatttcgtatttatccttttcgaaaatagagctctactagtgaaaaatgaactttacgtgtccaatttcttcgagaaaaataaaatctcaactccctaacggggagggcgtgcaacaaaggccagaaaaatggtaccgacaatgtaagaaccagaaaaatagatagaagaaaggaatagaaagagcgatagcaataacaagtagtaacaaagacgagatactaaaagaccaaagcagaagatagtaagaaaacaaccataatactagcaatctaagaacaacgacaagatactaacatacgagcaatctaagaacaacgacaagatactaacatacgagcaatctaagaacaacgacaagatactaacatacgagcaatctaagaacaacgacaagatactaacatacgagcaatctaagaacaacgacaagatactacatacgagcactaataacaagtacaagatactaacatacgagcaatctaagaacaacgacaagatataacatacgggcaatctaagaacaacgacaagatactaacatacgagcaatctaagaacaacgacaagatactaacatacgagcaatctaagaacaacgacaagatactaacatacgagcaatctaagaacaagtacaagatactaacatacgagcaatctaagaacaacgacaaatactaacatacagcatctaagaacaacgacaagatactaacatacgagcaatctaagaacaagtacaagatactaacatacgagcaatctaagaacaacgacaagatactaacatacgagcaatctaagaacaacgacaagatactaacatacgagcaatctaagaacaagtacagatactaacatacgagcaatctaagaacaacgacaagatactaacatacgggcaatctaagaacaacgacaagatactaacatacgagcaatctaagaacaagtacaagttactaacatacgagcaatctaagaacaacgacaagatactaacatacgagcaatctaagaacaacgacagatactaacatacgagcaatctagaacaacgacaagatactaacatacaagctctaacaaactcgcaatggatacgaaaaatgcccgactaactactaccctgatgtgtatagacaacaataaattaggcaaagctaaggtgtatatatatatatatatatccttagtgcgtgtgtgtgtgggggggaggtgttgtctgatgtattgataattatagtgatgttttattctcatcccttaaaaacaaacataatacttcactaaacaatgtagaaaacaaaatcaatagaaaataagacagtacaaataaagtggtacattatcctactaatgatcctacttaatagagtccataaccacaactgcttcatctaaaggcccataaagcagattgataatccaacaactaaaagataagaaagccatttaaatttgttgaagcagaaggtaatgctggcccgcagctacagccattgatccaatttttgggccacattttgttctttgggctggattttcacaggtattttcagcccatttttgcagctctcgtgttcccactagcgaagtacctgattccttctccttcgagcgagatcttatctaagccgtccgtatacatcttgattggattcgttacattacacgatgtaaattcttcctcgttcctcagctccactacactctcttgtgctgccgagtaggtgaaccctgctcatgtaatacaaatgatataatactctattttttttaaaaactattttagaaaatagttggacaaacgttctctttattgataattaattgattttcaaatatagttgggagacttaaccaaagaaatgattaaaaaaaatcgatagatcggaatatgagaatagatctgataccaatacggactacttatttcaaccgttgagttttttaaaattgcatactaaacaagtgttaaagtttctttcgatatttgcggagttgattatcctttcataaacaaagatttgaagttgtttatgatttaccgagtattcgatataactcacgtatttcatcactataaaagattatggtgagacggataaaatccctctatttttgaaaaaatatctaactcttaatattataatagcaagataaataataatcacaaaatcgaattaataataaatcttcttgaagatagagaaaacatagaaaaagaaaatgtggttggttacattttaatccttggatgtcacataatctatattcttagtactccataatttcaatttagatgattaattttatttggcacatctttttttttttttttaaaaaaaataagactttgaatatgtggtcttaaaagcttaagagacaaaagttttgtgggaccataatatttatgtggctataaaagtttcgggaaaagacctaaaattgcctctctactatggtatatagtttaagtttgtcctcccgttatacttttcgtccaaattcacccctaccgttaacaaactttctagcattgcgcttaaccctaacgtcccaccattaaaatctttttgttcatgggagttttccgacgaggtgtagcaatgtggagtgggttcaaggagaaagaaaaaaatatagggtgaagaagattcctaaaattttaaaataattttcctttttccgtatgttgatgaggttaattttaacgtgagatctgctgatatggcagctgatgtaaataaattaatagagggattgagtgcccacgatggagggacgttagggttaagggcaattctagaaaatttgttaaaggtaagaatggatctgaaacaaaacgtataacgaaaaacaaaattaaagtatatatcctaatagaggggtaattttgaacctttttccaaaaaaaattcattaagaataaagtaagcaaaataaaaaatttaaaattaaaaaaatatattatttttttaacggactaataaaaaaagtatatattaaaataattaaataattattattccctctattttttttagataaaatggagggagtaataattaaataaggtgtgggccaatttgctgatttctattttttactttattttgggacttcgtgtactaacttatctttgtccttttttttttttcagaatagtacagaccactcccctaaaaattaagcaccaattaaaaacggatttttcaaatatttttatggtccaaaataaataatttttagctattttattaagaaattcatctttcaacattaattagtaataaaattaatattatttaatatatgcttcaatattatttactccaagggtaatattacaaaaaaaattattctttcttgaaatctgaaaaaatcaattattttgaaccacaaaaaaagataaaaaatcacttattttggaccataaaaaaaagtaaaaaatcacttattttggtcaaaaaaaagtaataatatactcaaccaatgaaaaaacgtctttttttttaataatactcacaagttcaaagtacaagaacgaattcactttatttttcacgtgattttgaccatttgttttttgaactttttgattaaaatttcacatttaaaagttatacatattcttttcctcatgaatgagctgagtacatggacacgtgaatccatagtttttccgtcaaattaagtattttttatatatatttttaaaattgatcaaatattaactcctggtactaatgctctaaaaaagctaaatgatgcatttgattaaatgttaaattatttacgtagaggaatagggatcgactctcatttaatattttatttatttttttaatggtgcaatgtgtgatcatatataaattctagattcgcctctgaaaacaacctctttatcttaacaagtacgggtgaggtctgcgtatacactactctcttagacctacttgtgaaattttactgggtatattattgttgttgttgttgttatatttaaaagttatacataaaaaaatggagtattatatttcttttaattcaaaatattttaaatatattacttttaaacaccttataatctcttttgaaaaaaccaaaaccatatttcatcatccaaactagacatggaaataccttacattatagataagatgaaaccaaacagaccaataaaaataataaattattaatatcagataatttaaatattatagaaatgacgaaattgatatttttctcttatccttagctaaaaataatttctacaagtcacaacagaaaaatatgaacattatctgtgttagaaaactaattactctctccggtccgcaataattgattaatttacctttttattttatttaaaataaatgtctatttatataatcaagaataaattcaatttgccaaatttatccttatatacgtatattcttaaaaagtcttttactcctcacattatctatgttgtactccctccattccaaaataagttgatttttggttattttcacacgtattaagaaattcactttttaacattaattaacaatgaaattgaccgtattaatctttattattatttcacataaacactcataacaaatactagaacattatttactccaagggtaatataggaaaaaaaataattaattcatttttaaaatctagaaaaattacttattttaaaccacaaaaaggtcaaaaaatcatttatcatggaccgagagagtattaatgtaacaataacaacaataactacgtatttctccattaacatttcactctaatatattaaaatttaatttattgtggaaatctgtcttattttctagattttagtcgttaattttttttaattttttttatttatagataaattacatatatttatctttaagtaatatgttggtgtatttttactatacgtagggatttagagtaaaaaaggagaagaagctcacagattttgtcaccaactctgaaaattctaccagaggaccaagaagcaacatcagaagatgggtcccaccctctatcctctccgacgacatgctgcacttgatcatgagctccggccaccatcgccgccgtgagaagaacggccgccaccgtcacaaccagtaacttctttgcacccatttctgctagtaaaaacaaatagtactaagtttgagagcaaagcaaaggcaaagctaaaagctttaaataaagaaatgttatttttgagtgagaaatgtggggttttgggaatataaccttgtgcccgagggagcggggtattatcactttttgtcaatgataaaaattatttatattcagtagccgaaaagtatataaaatttatataattttgtatataacatacatagtatatatatatatatatatatatatatatatatatacaaaaaatatacctttttcggctattattttgagagtgattatagtgggcgtttggacataaaaattataaaattatacaaaacgtgagaaacaaatttcaagtgaaaatgatatttgaaaattagagttgtgtttggacatgaatataattttgggttgtttttgaagttttgtgagtgatttgagtgaaagttttgaaaaataactttttggagtttttcaaatttcaaaaaatttcaaaattcatattcaaatgaaaaatataaattttatggccaaacactgatttgaaaaaacaataagaactttttgtaaaaaaaattcttatgtccaaacaggctcatagtgtcatttttcctaaggaagttggttccctccaaggtagatggatggttgatctaacgctaggattgggatcgggatttaggatttaaacttaatatttctaaactttaaatatttttagtgctcgacttattatatttttgaacttggagagagtccgatttacgatttaaatttgataaatttaacctataataattttagttatgaacttattatacttttggaaataaaagtttaaaaataaaaaattttggttaaatttagtaaccatcaaggaatgcgatgaataaataagatttctccatccttaacatagttttcggattagagccgtgcgaacaacttcttagtaaagagcgtcttcctttctaattggtcctccgatttgaattcggactagttgagccagtagataaattctagattattaaacacaatatacaattttaataattctttttatacatcgaaattactatttcacttaaggtcgtttggttggaaacaaggtattcgttaattaattatcctaggattagttatctcacactctcatagggataaaaaaaactataattccggaataactaatcccaagattagttataccataattttatcccaaccaaacgtggaataaattcatctcaaattaatctcgagattaattaaccgttatccttcgtatcaaacgagcccttaaaattattgttcaaaatatccatcaggctctataggtggtaagtgagggtttcgtggtagtttcctgggaaataggacgtacttactataaatagaagtgcaagtgactggttggtaagagagttacctttcaattattttcatttttttggctgtatttattatcaattttttttatctaattacccccatgggtaaagattgttacagctcaattgctttttcatacctaacgtttacccccgtttttgtcatttgcttttagtggtggtaaagctaccacaatatcaagaatttgacttataacccgtttggacataagaatttgggagaaattcaaaaataatcagatttacaagcggtcatttaaaaataaccacagttttaaaagtaatcgaaatttagtcactttttatgttaaagataaatctgaatgaaaacactgtttaaaattcggaaaatactccagcataatatactggaattccagtataatataccgatccagcataatatgctggaagttcatacataggtgctctaatctccagtatattatgctgaaactttccgcgtgttggagttccaatataatatgtgtacatagatgcaccgatctccagtatattgtgctgaaactttccgtgttgtagaaaaatagtggttattttttaatgactttgcaaatactggttatttttgaatggccagtccgaaaactggctaggccgtgctatttttacaagaattttttcattttttttgatttttttatttgtttttttcgaagatcactgtttggccataaaatttttaattttcacttgaagatgaattttagtatttttcgaaattttaaaaaactccaaaaaattattttttaaaattttcactcagatcactcacaaaacttcaaaaacaacctaaaattctattcatgtccaaacacaactctaattttcaaatacctttttttcttttttttggaattttaaaattcttatgtcgaaccgcccacttaattagttgagttcctttttacttttcgttatcaacaaagaaaaaaatcaagagcaatctacactttagaactattatttgattgtaggagtttggacaatatacttcaacaattaatatttgtatacattattacgcttaaatatttcgaggcttttgcatttatatccgttttttgggccatgttttaacttatatccgctttgtaaaaaaaattgcaagcgtacccacttttcgcgtaaacttcaggcttataggcctgaagtagcaaaagcaattacacaaaacttcagcattctagcctttttcaaaaacttcagcataagtgctgaagttatttagttcatttgtaagctgaagttttgttctggattaattagttttgttataaagctttttcaaaaacttcagcagaagatgttgaagttatttagttcgtttgtaaaaacatcagcactaaataagctgaaattttgtcctgaattaattagttttctcataaagttttttcaaaaacttcagcagaagatattgaagttatttagttcgttttcaaaatctttagcagaagatgttgaagttattaagttcatttgtaaaaactttaacactagataagctgaagttttgtcctgggttcattagttttgcaataaagctttttcaaaaacttcagcagaagatgctgaaattatttagttcatttgtaaaaattttaacactagataagctgaagctgtgtattggattcattacttttgcaataaagctttttcaaaaacttcagcaaaagatgctgaagttatttagttcatttgtaaaaacttcagcactaaataagctgaagttttgcacaggtatcaggaaggtggcgcctgaaggtgtaaaaattaggatataagttaaataattttaaaaatatgggtacagatcaaatggaggcgaccaaataggacgccccgcgcaatttttacaaatattcctcaaataaattcataatattttcaaaattttgaaaaatcataatttcgagtttctacactacctctaatcaagactcacttgggtccttcatcaccataaacaagaaattttgattcgagcaggatataataatatcaatcacctgactaacattcagaggcggatccaggattcaaatgatcctatgggttcaattttttgatgtttttagtattgaacacattatatttttaaagttatgaattcatgtctactaattttgtaatttaataaatttttatatataaatttttattctatattcagttgaacccgttgatgaaacactatagtagtaagtaaatgagatttaatgacttcatatacagttgcataattaattaaacattaattatgaagcaattcatccattttacttgaaaatgagtgatgtacactcaaacggtatatagggtgtaatatttgtagtttaagcaaataagaagagacagaagaaactgcagccgaaattaaagagttgagccaatgtgtagggcaggggtgtatatggaccggattggttcgacttttattaaaatcaaaccaaatcgtttatattggttcgattttgtcggttttttcgggttttcgattttttttgttacataaaaattattccaataagttatagataaagttttgataaatgaatatatgtttagtaaatattgaaaaaattgacaaacatataatctattaaaatattctaatgggagaatttttgtagtaatacatgatagttgttttcttagtcgtctaacaataattttcgttaatgtacgctttcaaggttaacacatgtgaggatcccaaatattccaatattttttttaaagaaaattcaatataaagtcttaaaaatatatatatgtccgattttttttactcaataccaaaccaagtcaaactaaaactagtcggattttttaatcgatttggtgcggttttcctgttcgatttgaacacccctagtgtagggtttgttacctattggttaggggaaagagtagttattgtatcttattatatagttttgataacacctcatgagttaggcacaatgttactatatgatgcttattagagtcaaatgcatgcttattcttggtttatcctgtgtaagacaccatattatattatttacgcttcaaatatttaattttaaatgcgaagaggtggaatgttaaaatctcgatccacattgcttgagaaaatgagtagtctccttatatagtcttcagcagttctcatcttttgaactagtttttaggattatgttggacaactaccgctcgaaatttctgacgaaaaaaaaaatgtcgaaaatttccgaccaaatcagtcagaattttaaaataataccaattatattttttaaaaaataatttcggccatatttccgaccaaaatgatcgttattattggcgcaaaagttcgagaagttatttctgatcgaaccgtttgactttgactttagtagcgaccgaattggtcggtaatatttttttaaaaaaagaaaaatttgatcgatcgaaaatctatttttaaaccctacctaaccttcgttcccaaaaaatagaagctcatttttctttctttttccctcttctctcatcctcctcctctattcctctcgtccttcttcaccatcctcctccttctaggtaatgttctctctctctcttttcctcctcccttctccctctccctcctccctcatggattcttcaacctcctcttcccttttccccttaattttgcaacttttatttttagttttgcagtagtggcgccgtggcgacaactccatcatctttcttctccgacattttttctggcgaggtaagtacttcgttgacatatatcttattttaactgttaaatttatagtaattttatttgttataggcttattggattttctatatatgaacatcctagccagttgaattatgtatggttgaatttttagagattttagtttttgtaggtttatttgatctacgtatggttgaattggcattatgtaaaatttaattgtatatttctctttgtatgctataagtttatagggttccttataagaaaaacataataccattgttttgaatttatttatgaaatgaaatattaactttatagtttattgtttttaattgtattaactagctagttatagtttaaagctttggtgtaaaatttgttgtactaggttcattgttgcttgttagttttactattagaatgatttagagcttgtttggatggttgtttcccgttgtatcgtattgtattgttatcctgacacattgtttgttttgattgtttcattaaaattggttgtactgtattgttaaatccgttgttccggaacaatgaaaagtaccattttttgaaacaacggatttggtgtggtgggattgttttctatttttctttccaattatagtttattactctacaattctattttaccctttaccttttttttttaattttgttttaactccaaatctccaacatataacctactctttttttttccagaacttttgccgccaacgttaaaggtgttttggcgctttatgttttattttttctcctaatttgcttttaactcaattctaattagctgtgctctcttgttttgccttcttctatctcgctcctttgttctactttcttaaggtgttttgccttcttctgttttgttttttaaggatatttttatgcatcatttttgataaatttaatatttaaacaattgagggtattttagtaagcttatcagtaacagtacagtacgatacaatcaaaccaaacaacaaaatattatttaacaataacaaacaatacaatctatccaaacattgtatccataaaatgacacaatacaatacgacacaatatattataaaacgatgggaacagtgatcaaacagaatgttaaatttaaatcttttcataacgtttaacgtgtagggtttgttatatattggtttggggaacgagtagttattgcttttcaatatatagtttttgataattatactcaactcatgagttagggcaatgtcactatatgatgtttattctcagtagcggattcagaattttaaggttgtgggtgctcattttctttaacataaagttgctatcaaccacacagtacaaatgtacaattattcggaatgcaacagagaaaaaaattaataaaaaactatggttatcaaaaaataactactagtcgcaaatcaagtaggaattgaacccacacctctagtttcaaacacgcctttacttcaacctcaacaccacaacaccgattagtctttttggttcttgggtgcttgctagcatcttatatcaattttcttatattttttgcataactatacacagtttatgtggaggtcaatgggtgctaaagcacctaaaatttgtacatagatccgtcactgcttattcttggtttttcctgtgtgagacaccatgttatattgttcacgcttcaggcgtttagttttaaacacgcggggatagaatgagtagtcttcttatatgatctttagcaattttcatcttttgaatttgctttaggattgtgttggacaatcaccattttttaatatgataattgtgctaattaaaaaattgaatcacgtaaaacatgaataaactccccaacctaggttaggggatcgttaaaccgtagcttgctgccgaaaaatgttgctaggctagcacgccgcacgagatagcaatgacaggggattgaccggtcggaggttcgagaaagataaacattatattatgcaaatctgagaacatttctccccctattcctttaagatttatcttatgtagtgaattaatctttgatcttaattctaatcatatatgtttttaacgtaaagatttctataaggtctttcttgttcttgatattttctaaaatatatattttttgacttaatttcagaaaaaataaaagaataaataaaaagaggagcgaaatgctacaaaaagaactctgttcggttttttagtctatctataagaggagatcatatgaaaaacgtaaccgattctttcgtttatttgggccactggccatctgccgggagtttcgggtttaataccgatattttagcaacaaatccaataaatctaagtgtagtacttggagtattgatttttttttgaaaaggaagtatgtgcgagttgcttatttcaagaataggccggaccatccagctgtacccttttccgttataactaggaaagagaggtgcatgatctcgcgacttctgaataaattcaaattaatataaaagactattaattaaatctctcgcagtccagctctttcaattatttctaatttcttacataatcagtctattatttgagcatttaagagctagatagatgtaataatactccaatttaataacaagcttactttattaattatatataaaagtatttggcgaagccgtggtccatttttattttgttggtagtgcatgttttgtgtgttgatgatataatgctattacaatataggtaaaaacttacccgtattcgatatttacggcaaaatcattctattagatcgaataagtacattccatctaataagtatcttgtgttagaattgagaaatacgtatgacacgagcatgcatatgagttaaattgttcattattttacatttcgtacgagttaattgcactaactttgatcaaatttaacgtaattatttcataattcaatttgtcaaattttcagctcataatattttttagtagctttcaaatgttatttttgttgggtttttaagcattaataagcttaaaatagggtgaatgggaaatggagggaaaaataaaatatttgagtaatatttaaggttccctccttgatcgtcccatatgggaagaggaaaatattttttgatgggtatataagtaattgctcttcttctagctcttaaagagttgagaagaaaacaagtcttgcgccgtcgtcgtcgctcggctcgactttggctaatttttgaaccaattttatttgttaatattaaatattaacagatatgttattaaatatttgtttaataacaaaatattacccttctcctcctttattctgcatatttttacttcaaagaaaacaatagtaagtgtgatttgctaccgaactttgcgttcgctgaaacattggggtttgaagtaccactacaccagtgtgtaattcgttctatcctgggaggaaataatccataaccttgggtactaggaaaggattaaattccttaaggaaacactgtgaattcagtgggctcgaattagtttttttttttatttcatttacatttctgtttatgttatttattttctccagaattattgtacaaatacagaatattaacaattttaaatataagaactttctgcacataattttatgtccaaaagctgatcgaattagtcccgaaaaataaaagggccttttgaattaataattattggaaatcttactggaatatcactacaagaaaatatattattagcaacaactttttagcaacaacaatgatatcgatgctaaatatcaataaatggcaatatcatagaaattttacccacaaaatttttttgttgactaacattttaattttgttgccataattttttgtgtaatataataattttaaaatataaataaactggcaacagtaaattgtcagtattgccaaaattattttcttgttgtaaaaatacttatttactcaagaatatttagttctttctcaatttttagcaaaaataaaagcggcaaatttccctcccttttatctctggttttaatggacatttcgggttctaagggattgaatgttagtaaatacttgtttatatttattggcatttatatgtatataatttattatttttatacgtatttgtcaaattattgttggtaaaactacttttggcaacaatatttgatttatggcaacaaaaattattgttggcgaatgccttcatccttgtagtgaatgtatcaaagaaggacactatttatcaataactagtcattttttttagttatgctacataaagcaccaaaaaattaccaataatatacaacattcaaaaaacataagtaaaaaaaagatttttttaataggtattattgtgatacattaaaaacacataaatgatgtaatatgtaaaatttgacgaagtttgaaggcgagttagactagtttgaaatcaaaattcattactaatgatataaaatataaaattaggtatagttggaattcgttgaagacatagaaatgaggcgatatacaaaatttgagcaagattggaggtgatttgatatcaaaattcgtagttaaaatcgagtttaaaatgtttttcaggaatataagtatcaaacatgtattgcgtatgtatctcacacacatatatacatggatatatatgtgatacatatttgatacacatgatacatatgtgatacacaatgtatcatatcatctttttccatgttcaccttctacttcgaattttcagttcaaaccacctcaaaactccaacaagtcatcccaaaattgagatccaaataccttaagatatacacaatctattttaatgacactcattcaaaagaaagcaaaactttgacatttttttgcctacaaataactaattgactaatattaatagcattttgctaatattagtaatattttatgaattgataaattattataattacttgtaggtggacatagcttgatagatttccataattattcgaactttaaaattacacaaatgaaaattcagcccactaattattcgaactttaaaattagtaaaaatagcatgagctagccagtttttagactagtcattcaaaaatggccaatcgtttgcaaagttattgaaaaatagcagctattttgctgcaacacggaaagttccatcataatatactggagatcggtgcacctgtatttgaacttctagcatattatgctgaaactccaatacacagaaagtcccagcataatatactggagattgaagcacatatgtatgaatttctagcatattatgctggacgagtatattatattggaactccagtatattatactggaactctagtataatatactggagttgcactatatttatgctggaactccagtatattatgctggaatatttcccgaatcttgaacaatgttttcgttcagatttatctttacatgaaaaatgactaaattttaattacttttgaaatatatggctattttgaatgatcactcgtaaatctggctatttttgaatttctcccttaaaattacacaagtaaaaattcagcccactaacttgctacaccattgatataatgtgaatcatgaaacatacttatttttcataaaaatataagaaaaaaaggaaaattactctctaatttggtccttccataagctcacaagatccacaagtcttaggcctcgtccgttttattaaaataaaaatattttaacaaatgcacttatgattgaacgccaatatgtaagatggtttgtttctgatcatttgaaagagtttaattcatctcgaaactatgaaatatagaattcaaataaactaataacaattattatattcacaaaatattagaaaaggctattaaatttatttgaccgttcgtcgtattttggcgatttagattatagggccatgaaacaagaatttaggacgattccaagattttgcgtactataattcacaccatctgcatgaatttaggcgatcggcccgaatcttctaatattttgtagaaccataaaaaatgaaataataaaaaaaatcatcgcttcgccatgaccgttcctcgttttttggtttttagggtcataaaacatgaatttaatacgattcccatattttgtgtactatagtacatgccatcttcataaattcaagccccgaatctcctaaactcttgcggacccataaaaatggactgaataaacaatagttatcgcttcgtgatggtaggctataatatcatgttttagtcgattattacattttaatttactgcactttagttgagtttgagctttaatcgctagtgttttgcagtaattatgtgttttatgccttgcaggagtgattccgagctatgtagatgttataaaatgaattcaagtgatttggagctttgaagtctgagtaaaagtccaaggaattatgtagggatcttgttcagggatcgacagatagttaaggacgaacgaagaatcgagcaggcatactgcgcagtgtccagtaaaatgcacatgatttttcgctcggaactgagtttgggctccacaatatattgttggaaagataatttgaaggctacaactttcatattttacatttttccaaatttccaacagaacatggtgaaaagtgcgcggcagcgcagtggctgcgcatatggggcagaacaatgtgaaagtgcgcgggcatacttccaggtgtgcggccgcgcacgtcctgttcggaaaaaaagtgtccttttttcgcataggggatgtatgtgtttgggaacgaccctacttgatatatatacattgaaaaacgatattttcaggacttttgacatatctaagacccgggaaagctaagaagaaggtggagaagctagagctcaaggaatccatcattcaatctcaactcaagacaaaggtttagattgtttatgtttcctttatcttaaacactgtattgatgaattactccatatccatggagtagttctctttagggtttgatggatttggtatagtgatacttgtttgtgaacaattaactctagtttttatgtattgaatcattttggatgttttaatggttgcttctatattcactagttcatataatcgagagatgcataacttgtgatattgttgctttatattttgttggttgaagtcattaattcttcttagtaattgaaatagactagttgaattgttggttaaatctagttaggagaataatcgagagaggttctcctaaagaccaatccactacgaattcttgcatatcttcacgtgcttaaaattggttcatcttgtgagtttgaaacttaatcgatataggagtttctactaaataattgaatcaataatcaagtgaattcgagagactcacttgaacattagaagtgaattaactagagttagatcccaaacacttatcgtacatctatcctatcaaccctattttctcccaattgatacttcctttgcttaatacttgctttgattgtcattagccaatagtttagactcttagttaattttagttttaaatcaaataaactcaactgtcaatcatcttggatagcaatctagctacaaactacgataataaatgtttaacttcaatccttgtggatatgatattataatcactatattcgactagcaagaatatttaagtgtgggttcagaactcgtcacttcgccatgatcgttccacattttttgcgttttaggtttataaaagaggatatcaggacgattcccatattttagtgtgctatagtccacgtcatctacttcattcaagcgaccaaccccaactctcctaaagattttcatgctcataagaaaatgacctaacgaataatagtcattacttcacgatgatcattcctcgctttagggtcataaaacaggaatttaggacgattccctgatttttgtctattatagtccatgaaacgacctaaggaagagtagggccataaaactggaattccgccctattcctaaatattcgtgttctatatctcacactttctgaatgggcctggcccactagacccgaatcgcctaaaattttgtcatcccattaaaaatgtcataaggaacaatagttaccaccttgccatgactgttactcgatttttggcattttagggtcataaaactggaattccacccgattcccaaattttcatatgctagagcccatgccttctgcatgggcccgagccaccggatccggatcgcctaaaattttgcaagccataaaaaatgtccttgggaacaatagtcaccgcctcgcaatgatcgtaactcgttttattttgcattttaaggcaacaaaattaaaatttcgcctgattcccagatttttgtgtgctaaagcccataccttctttatgggcccaggtcattggaccagatcgcctaaaattttgccggacaatcaaaaaatcctaaggaacaatagccaccgccctcaccatgaccgttactctttttggtttttagggccataaaactggaattccgcctgattccagatttttgtgtgctatagcccacgccttctaaatgggaccgggccaccagcccggatcacctcaaattttgtcgtcccatcaaatacatccaaaggaacaatagtcacctccttgctatgatcgttactctttttttatgttttagggccataaaactggatattgcctaattctcagattttcgtgtacacaggacccagatcacctaaaattttgtcggtccatcaaaaatgtcctaagaaataataagcaccacctcgccatgacgttactcattttttggatgttttagggccataaaactggaattctgtctgattttcatattttcgtatgctatagaccacgtcttctgcatgggttcggaccaccagatccgaatcacctaagattttgccagcccatcaaaaacttccaaaggaacaatagtcaccgcctctctatgatcgttactcattttctgcaaatccaccctattctcagatttctgtgtgctatagtccacgccttctggaagggcctgggtcaccggacacggttcgcctaaagttttgtcggcctataaaagatgtcctaaggaacaatagtccctgtctcgccatgaccgttactcattttttgacgttttagggccataaaactgggattccgcccgattcctagatttgtgctatacttcatgccttctgtatattttagggccaccggacccggatcacctaaaaattttccagcctataaaaaacgtcctaagaaaaaatagtcacgtcctcgccatgacttttactcttgttttgatattttagggccataaaattgaaattccacctgatatccaaatgttcgtgtgttacagcccatgccgacgcatgtgccccgggccaccggactcggatagcctaaaatttttctggccaatcaaaaatgatttaaggaattatagtcactgcatcgctatgattgttcctcattttttggagttgtagggccataaaactttaattctgccctattcctagattatcatgaagcctacaccatttacatgggctcgggtcgctgtatctggatcgcctaaaattttgttggcccatataaaacaacctaaggaagaatagtcattgcctcgccgcgagtgttcctcatttttttgcgttttagcaccataaaattagaattcgtgcgatacccagattttcgtgtgatgtagcccgagccatctgcatggacccgagccaccggatccatgtcgccaaaatgttgccggcccatcaaaacgacctttcctcattttttggcgtattagggccataaatttaaaatttcgaccgatcctcaaattttatgggccaatcaaaaatgatctaatgaacaatagtcattaattatccatgcacattcctccttttttgcatttcaagccatataacaaaaattcaacatgattttcaatttttcgtgtactaatatccatgtcatcttcatacggggaactagccccaaatcgtaaaatttgtgggtccatcaaaaattacctaatgaacaagagtcattacttctccatgagtcctcatttttttggtttttgggccataaaagagagaatttgcatgattttcgatttttcatgtgcaaatgtcaataccataatcatgaattcaggtgaccagcactgaattgcctaaattttgtaggcctatcagaaacgatcttatgagcaatagttattgcttctccatatttgttcctcgttcttttggaactttagggccattgaacagaagttctagacagttttttatttttcgtgtactaatatccatgccatcttcatgaatttgggcgactggcctcgaatcgcctaaagttttgtggacctatcagaaatgacctaataaaccatagtaatttcttctccgtgagtcctctttttttggccttttggtgtcataaaacaggaatttagcttgatttccgattttcgtgtgctaacgtcaatgtcatcttcatgaattcgggcaaccggcaccgaactgcctaacttttgtgggcccatcacaaatgacttaatgaaccatagtaatttcttctccatgagtcctccttttttggccttttggtgcataaaacaggaatttaacgcgattttcgattttcgtgtgctaacgtcaatgccatcttcatgaattcaggcaaccggcaccgaactgcctaacttttgtggtcccatcagaaacgaccttatgagatacaatccattgcttctccaagattgttccttagttttggcgttttagggcgataaaattgaaattcgacacgttttttaatttttcgtgtgctaatgtccacgtcagcttcatgaattcgggataccagccccgaatcggctaaaattttgtgggctcattaaatgcaacctaatgaacaattctcgatgcttctcccatgatcgtttatcatttttggcatttaaggttgagaattcagtatgtttttcaatttttttttgtactaatgtccacgccatcttcataaattcgagtgaccagcctcgaatccctacaattttgtggcccatcagaaacaaccaatgaacaatagtcattgcttattcatgtctgtttctcattttttacgtgcaaaggtgcacgtcatcttcatgaattcgggcgattggcccgaatcgcctacaattttagggccccgtcagaagcgacttcatgaccaatagtcattgcttctccatgattgttcctcgtatttttaagttttagggctataaaacgggaattttgcataatttgttttgtgtgctaatgttcgtgccatcttcatgaattcagacggccggtcctaaatcgcttaatatttgtgggcccatcagaagtgacctaatgaaaaatagtcattatttctccaagatcattcctaattttttagctttttagagctataaaagaggaatacaacacgatttctgatttttcgtgtgtaaatgtccacgtcatcataatgaattcgggtgaccggccctaaatcacctaaaattttgtgatcccttcagaaatgacccaacgaacaatagtcattgctttattccttaaaacaagaatttagtatgattttttattttgttgtatgctaatgtccacatcatcttcaggaattcgagcgaccagccccgaatcgcttaaaattttgtgggcccataaagaacgacataatgaataatagttagtgcatttccctacatttcccatttcttggcgtttaagggccataaaccagaaatttaacacgattttccaatttttcgtgtgataatgtccttgccatcttcatgaattcgtgcgaccgccctaactcgcctaaaatttgtgggcccttaaaaaataatccaatgaacaatagtcattgcttctcaatgattgttccttattttttggcgttttaggccataaaataggaattctgtacgatttttttatttttttgtgctaatgtccatgtcatcttcataagttcatacttccggccccaagtcgcgtaaaactttgtgggaccataaaaacgacctaatgaagaatagtcattgcttcttcatgatcgtttctcattttttgacattttagccgtaatataagaattcagcacaattttcgatttttcatgtgctaatgtccacatcatattcatcaatttgggtgaccaatcgcgtaatgaataatagtcttctccatgacagttactcgatttttggcattttagggccataaaacaggttttggcacgacttagggccataaaatagaaattaagcactatttccgattttgccagtgctaatgtccactgcatattcatggactcaggcgataggccccaaatcgcctacaattttgtgagcccattcgaaataacctaataaataatagtcattacttctccataattgttccttattttttggcaacttaggaccataaaacaagacgtcggcacgattaaagtccacgtcatgttcatgaattctggcgaccggccccgaatcgcctaaaatcttgtgggcctattagaaacggcgtaatgaataataatcattatttctccatgacagttacacgttttttgacgttatatggccataaaacaggaactcaacacgatttcccatttttcgtgtactaatgtccatgccatcttcatgaattcgggcgacgggccgagttgccaaaaatattatggacctatcataaaggaccaaatgaaatatagttattgtttctccatgaccgttcctcatttttttggtgtttaaggccataaaataggaactcagcacgattttcgatattttgtgctaatgtccatgtcgtcttcatgaattcgtgggaccggccctgagtcgcctgaaattttgtggacccatcagaaatgacctaatgaaaaataataattgattctccgtaattgttcctcgttttttagtattttagagccataaaacaggaatttagcacgattttcaatttttcgtgtgtaatttccatgccatcatgaattcaagcgaccagaattgcctaaattttgttggcccatcagaaacgacctaatgaaacagtcattgtttctctatgaccattcgtcatttttttgtatttttcaatacatgatttaacacctatatttattccaaacgagctcaaatttaaaacataacctccaaatatcttcaagaacaaatcccaattatcaatttgttaaaataataacaaatttaatgcattaaaaaaaaggaggaggagaaagagaaaaaggtctgaagttatttgtactatgagtttcctttaggttgtttaagtaggcaccacgtgatcatcaatatcttgtgacaaaaaaatctctcattgcaagtttattctaatgtttactatgtattgtaatagtttagccacattatcatttacatcaggtttatattttcttaatgcacataatagtttccctccccctccacctccccgtcttatgtaactttaatgatttctaaaattaaatttgaatacatttttgtcacaatctaatttttccttcgttggatattgtaatggcacttaatcttaagaactatataagcttaatatttacgaaaaatgcaataacaataatttaacattctaataatttctgaaatgaatcctttatacaataaaaatatttccaaaacccaatagtacaagacataagctctatagaattgtactataacttctaaatataactattcagaaacaaataaaacagtgtatgaaaaaaataggacggttactccgaaacccgcgaacattgtaacatgttttaccttgagtctccataacaacaatctgtactgctagctaacgatcaacaagctacgcaatacctgagatctgcacaagaatgtgcagaactgttgcatgagcacaccacagcggtgcccagtaagtattaagactaacctcggtgaagtagcgacgaggactagtcaagacacccattgatctaataaattgaacaagtataagtataagaacaatggaaaatgatatttacataaaggctacgcaatatgtctaacaatacagtaagtttaataaggaaggaaacaacaagtatcagctgaaaaaccataaaataacaccgaagagtgaatggaacactacctaaatcccgtatcacatacacaacaagaacaagtaataactcaacaataatacaactacttttacatcagatttttagtcaactccatgaggtacgaacctcggacaaatcacaactcacgggtcccaatatctgaacaattacacaatatcaatatcaataacaagaatgccccagtctaacacaagtcatcacaaaacaatctcccacgcaacccaccttgtctcgccacgtgtgcaatagtaaagtatatgcccgccttgtctcgccacacgcacataatcatgttcccaccttatctcgccacatgcgcaacccacatatacatatcccaccttatcgcgccgcatgtgcaatattaatagtaatcacggtacggcagaaacctcgtacaaatccccatatccacaaccacacggcagaaatctcgtgcatcacaataaccacaactagtacaatagcaacaatgataataacacaaggatatggtaaataaatcaactcaataaccttcgatcacaagaaaaaggtaaagctagttaacgaggaagaaccacaataagaaaaactaggcatgatgagaacatctcaacaagaaggaaaataacatgtaacaatagtccacattgtacggtacaccaacaagaaactaacacgaatccaataatttcaaatgaagttaagtccactaaggtatagaacctctaagcttattctaaggttggacaattacgggagttggtacagccaattcaactaaaagtagacaatgagaagatcactatcacttcaaataaggagaacatttacaatacatgaataactacaacatcaaatagggataatcaattagggagaaggcaacatggcaatggaagaaaaacaatctcaattaaggcacgtatgaatcaaattcaataagagtaaatcatgaagcaattaattctaattaagcaagtaaaggtgagacgagtaattaaggaacataatcatgcaagaacaactacattttcaatggatacaagaacctaggaaccctaaaaggtcaatttccacaacataagtccgagcacatactcgtcacctcgcgtacccggattacaaacaacacagaagactcaaatcatatagggtagttccccacacaaagttaggcaagatacttacctcaagaagacaacccgatctcaaaataaactttcggtgaaaaagaccttcggacggctcaaatcaaaccaaaataacttcaacgcacaaataaaactcataaagtctaatctttataaaaatctaaaaatcaacccaaaacacaacctccggtcctgcacttcaaaacccgacaaatttcacaaaaccgaatacccattccgatatgagttcaaccattctgatggaatttgaactccaacatgattaatataaatacctaaacataaatgatgtcaatagtcgttacttatcattaaatagggaaaatttcacgtaagaataactgggctccctacttttaattttatagcctatattttaatttcaactaactatccaaaaaataataggctaatactcaacattcaacaaaccaaatccatttgggtggtgaaaattaatttttaacaagcttaaatatgtgaatttaaattctgaatttaatttagtgcgaaatttgaaatgagtgttatttaaacttgttagaaatagtataaggaggttgtataagaaattttaagtcatttaatggagatttgaactgattttgaacaagaattgcaattgaaaatcgtggaagaagttcgtctacatatgcttgtataaaggtgtataaaagtgtatattagtgtataagatgtgttcgtatacgcatatacactatgatacaagattatatataattatacaaaaaaaaactgatttcgtctttttccttgcatcttttctgaaatttaactcaaatcttgctcaaatctactccaaatcacttcaaatttaaattttgaactccttttgatattttcaatcaattgtaacaacactcgatccaaacaactaacaaactcaataaatcctattttcgaaagcaaagttttgaatggcctttaatggtggacttctactcttcaatttaatttattgcaaccaggtgacatacggatagaagcagtaatgacggaggccccttgaagtatatgtagaagatgtgagagaagacagagaataaaagcaataattgcgagaacatagatttaactccataacttatagaagcaatgattgtaaaacacatattttgagtttgctaatgctttcaatatatgtataattaggctaggtctgataaaacttaaaaatatgaatcattttttattattatataaagtcacgtgtattttcttataattctttctatatttttctagtataccacgaaactataataagaggagaaaggagcttagctttatcatgagttgagattcaacgtatctagacggaatttcaagttcattgaactttcctctctataaaatggaacttaattgctatctcactacaaacattacggcgtaaatttccgcatatgtgacaatataatataggggttttcggcaaatgcactcgtgcataatgaattttttttttttttgatttttcactcggcatgatatttatatcggggctccaactcagaggtgcggggagagtagaaattatgtatttggccgaattcagtaactttagtccaaattatgtattcgtcttaagaaattaagtgaatatgtacagataattaatttggaaccgaggaacttaaaagatttagaattcctaattcataagcctcaaacatactctgcctttgttccaactagtcaagattcgcgttaatccatatatagagtataggggaagtgcttcctaccaagatgtcttccatatccaaagtgcagcctggtgcactaagctccgctatgcgcggagtccgggaaggaccaaatcataagagtctactgtgcgtaactttaccctacaattttttctatatccaaagctaaaaaatccgagacatctagttcacttaatgcatgtaggggggctggggcttttcccctacgaacccttttaaaggagaaccagaagaacaacaatgaactcaaagctaatgaaggagatccgcaacttgaacaagatacacggaatcttttttggtctagtcggtagaaccggtgaaccacgcgaactaattagatgcgtgggacagagggctcgtagtacccattgaggaatcatattcactctatcacaaccaagatgctaatgaaattagctcgtataatgcttgaagcgatttggaataggtcttgtttggttatttctaagaattgaggcaattggagacatttttatattaccaaatgactagtactttttacttaatcattttcttcaaattattttcatgatatcatcagagtgttgtaattaagaaaacattaatgattaacattttccacttggtccctttttagtcatagccatctctcaattttaaaacaataggtgatcaatggtaaaacatctatatatatatatatggtgtcatttttaaccattcttgaatcttgaacaagtcaaaaatattactagttgttactgatatatactttgtaacaaaagcaaaaagttgattcacgtgatgattgtgagtaaaaagcaatattaattaataaatacaaaatagtaaagtaagaaaaaaaatggactttattttattcatgtccgatccaagatataataattaatttattgattatcgatttatagaaagtaagttactcctgctacttgcacacaggacggatttaggggtacccgaacctccttcgtcgaaaaattacactgtatatgtaagataaaatctgttttttatctctatatattatggtttgaatccccttaacacagcccaaaagcatagcgtagtggtcatggaggttcaaaacctttgaaaggtcattggttctatcaccgctaactataacttttgtaactttttccttttttgaacccctttggcgataatcctgcatccgccacgtttgcacaattgactaaggtacaaatatcagcaagttggtgtgggtgaaatgaatttctttaattaatattaatttaattaaagaaataaaatagttggagtgtgattttgttagatgcgaaatagtattttgaaaaggtgcgtaaattttgatcataaacgccaagttcaagcttttgcttaagtgttaaattatttttacattattattggattatcccttaaatgatcatttagctaaacaaatgaacttattcttatatcatgtctacatacattgaatatacactttaaccaaattaccgtaaaataagaatctacacagaacccaaaaatatataattatcgtaaccaaattattacttatatatatataaacgatttataatcaacataatgtcttcatctttataactttcaaaaaactccattaatggttagtggtttcttgtctgtgaacattttttctccattatagcgacataattgaatcatcataaaattttgatttcgtctttaaattcaatcatttgaaggaaaaaaaatatttgattagaagaaaatgacgagatttttaccggtgaagtttaagagagtggcggcggcgtttgatgaggtggcgaaagcgaggctttgcgaaagcagcggcagcgaatactctccggcggcggcggcggcggcgagcttgacggatttatcgggactcgtgaattcgtttttagaaagaggcgaagaagagggagttattaatgatgagaatgagaaattagaagaattaatggaaatggtgagaattgtttcgatgagttggaaattatggaaaatttgaggaatttgttaggtattgaagaaaattcaactgatgatttgaagagaagtattagtgctgctgtggaaaatgtattgcttgaagagaatgatcggagttcgccggagtttaaacggcggttgatgactcgattgcgtggtagaggctttgatgctggtaaacactttttctatttaaaaaaatactctacttcctctcaatttagatgacacatttaatttatccaaagttaaattgtgttaaatttgatcaatattttaaattatattgacatgaaaaatattgtgacttatagtacttttcggataatttttaatatttaaactttattttaaaatactaagttgaactaatttaatataacttcaaaatttagtcaatttaacgctcgataagcaaaatatttcatctaaattaaattggggaagtaatttttttgtacaatattaatgaccttaaaataagacaaatacatactaaaacaagttaaaaaacaatagaaagataactgcatgtataactatttatatttataataactcgacttgctatgatttttgttgaagatactgatatatattatctctttttgtctccttcgttttcataagtcaaaaatctatctgaaacaggctctttattccatcggatagggtaagtcaatgtacacattacctccctccctcctccctaccctggattttactgtgttattgttattgtagtagtaagtcgacttggtgacttgaaaaatagaggttatctattatacatattaaaacataaatagcgcaaaaattagtcggtgtatattaaattaaattcttatcttataattattttcttgtaatattcaatctttacaggtttgtgcaaatcaaagtgggaaaaatctggaaatcgtacatcaggaaattatgagtatatcgacattaatatggccaataatcgctacataatcgaggtatcattagctggagaattcgaaatagctcgaccaacggctttttacacctcattactcgaaatttatcctcaaatatttgtgggaaaaatagaagagttgaagcaaatattgaaaataatgagtagagctataaaaaaatctatgaaaaaaatggatatttatgttccaccttggagaagacttgcttatatgcaagctaaatggtttggattttataagagaacaattaatgagtttaaattagatgataattatcagaaaaatagttttgattattcttctaattattcaaagaagaaaatagctgttggatttgtgccaatgccaacaattctttctattgcagagagaatattatttcttcaaataagggcataaaaatgggaaatttggctgcagctttgaatggatgatatataatgagaaatataagtttgtttcatttgttataattagaaagctattcttgtgtagtaattaagttggctttagtttgctaatttttttctattttgtgattagttgggaaattaagttgcaatgttgtttaattagaaaaaattatgagtaatatatttttccaagttggtcgagggttttaattagtatgttgcaaagtaatttgtacataaattatgtacttatgatcaagtaatagagaatatcaaaattatgcatgtatctattcgtttcttatatttagctttcaggatgaaaatttatattattgaaccgacagaaaacaattaatcttttaaatctttatcagtttgatatatatcataaaccatatatatcaatagatgaattactcatgaaaatcattttttccctctgaatttgcttaaattttacgtcacgctaggggtggtaaaatagttgaaagaaaatagttaaccacccatattattcactaaaaaatggattagataatgaattttttaaaaacggaataaatatagataaagaatcatattaatcatttggaaaatggataactaatggataactaatgagtttaatttttacatttctaaagcctcatcaaatttgtcaagtttgggagactagaaattctccaaaagtgatcatattcaaaaagccatgtataatatcgttactcatattatccgctggttaaccctttttttatccgtgctaaatatggatcaggttagataatttatctgttttttcattacctacttttgactcttctcatatccgacccgcccgcttgccacctctggattagtatattcatataaaattaataagaatttaatataatactccctccggttcacaataagtgaccaatttgctttttattttggtccaaattaagtgttcatttatataatccagaaagaattcaatttgtttttacaaaataacccttatgtacatattcctaaaaagttttcttactcctcacattaaatatttaattaaggctaatttaattatactaggttttttatatagaatttaatattttcttaatgaccgtgtcaaaaataaattaatcacttattataaaccgaaaagaatattagttacgttgatttttaaaatagttcatggccgagggaggtagcatcttgctttacaactttcagtcaagagtaccagaattttattcattatagaaatatggttaatagtcaagattaggtcaaatatcagtctaatagtcaagatttgtagatagttcgatttactactagaatatgctatttcaccaacaaacaacaaaatcaccatatagtgagcgtttgaacataagaattgtaaaatttcggaagaaaagttaaaaaaattttaacgtaagcatgagactttttggaaatatcggtgaacaagtcaataaacaaaaagccaaactttagagtttgtgcagtagcaataccaaatcaaatacgacgagtagtggagttttgagctaagctttggctaaaccttggaaatcggcaacgtccgctcctactcccgcacagattgaagaagcattccagcgaaacgatcctttacaatgggctctgcccaacacttggactgactttatacagagagaggaaaatcagcaaaaacagtgaaagaatattctgaatttcttcaatcgaagtgaattcttagcttttttctggattctttctagattcatgatcaattcatagatcccgatagaaaataaataggcactcaaatcaagtacatgttcgagaatcattaaacaactccttatcaatctcgactcctttaaatatgaacaacaattcaaccgatttaattaactagtatataacaagtatggaacaaagaaatatattggtactagattgacttaaagactattctaagtaagaagagctttttggattaggaaaaaaaaaaagaagcaactttgctgacaattacatattttttattttgtcagaaaagtcctccgaatattttggtcttacattagtttcgatatctttttggaatatgaacaaagaagagaagataggctcattacattcataaaaaaaatgagaattaaccttaagtaattgagcgtagagctaaataaatcgaaagattcatgtttggttcgggaagggattatagaattttggaaatgaatggaaaaataattttctttcattaagtgatttattagaaaacgaaaaaaaaaagaaaaagaaaaatcaaatggtcgttttattcaaaaccccaattatgacatcccttctctctcatttcacggacctatgaatggggatattttcgaaactcacacagaaaaaaggaagtgagtaagacaaaatcccgagatatatcacaaactctttcacgagctatactcgaaccagcagatcgattcaacctctgatcaaaaagatataccttcgttatattacatctcttcaacaagtttagtaataagcataacgaccatattattccgacgtaccggaattgataacatccgagattatacaggattatacacaaaaaattctttgttggctctctctttagccctatgtctcttatccctaggaggtcttctccactagcaggtttttggaaaaactctatttattatggtgtggatggcagtcgtgctgctaggcgaagtagcttgaatactgcatcctagatgggaagttacaaattcgaagaactcgagaatttttgattgaatcatgatacaaattacagagaagcataatgagaatgtatataaccctattccggcatggtccgatatggaatgaacttataatcaggaagtgagggtactcattcgaatcgaacagctgaaagtactataactcctatttttctgctttaaaagaagccttatagctcgtgttaaagcgttgaagagagagataggacatgaattaccatgtcctttcacctatatttagttgtgtggttggtctgtgtgtgtgtaagtttcctattttttctcaaaggagaatcgaaaaaaatcatattttcatataatatcttagttaaattatatgtaatgatcaataagttaaattgaattctatatctacacataccaaaaacatatcttaatttagacaaattaataacttaggtttgtgataatttgtaaaatacatatgcttgtgacaagtaggataaatcatatgagtgttctcctattccgacttccccagagcctacagtagcacagccgagacagcgacaggttctctgaccctgcagggttttcgataaaaccttcttgtaaaagcatttgaacaatattttcggtaatattagtagatgctattcgaagggaatttgaatatattatcgaaacggttagctccatctataaatattttgcatcaaaagtcgaataattcgatggtttctttttgtatattatatggatgatccgatccacaaggaccatgattgggaaggtgaaaatgatatttcaaaactatagttgtgtttggatgtgaatataattttgggttgttttagaagttttgtgaaagatctgaggtaaaattttgaaaaacagctttttggtgtttttcaaatttttgaaaaattccaaacttcatcttcaagtgaaaatttaaaattttatggccaaacattaattacgaaaaaaaattaataaagtaaaaaattctgttttatattacctgtatctggggcctttcaataatgatccttttaaataattatgggagtccaatggactttacattagattcatgtggtatatgtattcttatgttcaaacgggctcttagttaaaatatcaagaaacaaataagaccgtctgtttcatatatatatatatatatataatgtttattgctttttcgtttgacttctctaaattaaaattctggttgtgcccgctattatgacaatcagataggtttagtgcttatcttcatccctgggaaactttcaaactaatatactagtgtcaaatatacgtttgggtcatacacataattaactatttcagcacaaatatacatggggcaactccagactctccagaggtttttaattgatcagttctcaacagaggccgcaccagaatttgaaatttatgggttagggattctaaatcttttaagtttttaggttctaaattaataatttatacatgttcaataaatttaagctagaacttaaggtcgaccccttttcatttccctatttgatttagtaagggggaaaggcagtccgcttaccatatacagaagatcgatatcgcacagaaggcctgatatcgccctatttgagatactgattcaagtcttagtactaacgagacctactgggctcggccgactcataggttctaccctccctccgcccctggttcttaatctaaaagatcaggcatgacttggaaggagcatatagtgcagtgtaaatcctaagataggagtcgagtctaacaacattggacctcaaaatagagtttctattataatctgtgttcctatgtatgaacaaactgagaaatccctttagaagaggtataggggataacctttttgtggtaatagtcaattttgaactgaacctattctgattgtctatttttctttaactaataataccttcaatgaataaaaaaaatatacgataactattgagagtggaagtgacacataacacgtgcaacttgtgtgaggtagttagctggcaattagactagttagttaggcggttagtgggctgagataatagttaattctgcagcgtaattgttagttaatgagtagcagttatcttctatataagcattgtattgtgtacagactgactaggtgaaaatgagaaagtaaaattctctccaccgactctctctagaacattcgatcctccattgttgaactctcaattcatctcttctacttaaactttgacatggtatcagagcttacggccatttatatggtctctctgagaaattgaattactgaaaacaaacttcatcaaaactcattaatggcggacaacatcgataatgagttgccgaaaaaattgagccacaatcatcacttttttgcaatcgatggacaattctcgaactatgttgatatccttgcaattgaccggtacagagaactattccatttggagtagagcgatgcgaatggcgattctaggcgtaagaagctagggttcatcaatggtagttgcgagcgagaaaattacgatccaaatttagtagatatgtgggaaaggtgcaacgcaattattttttgtggattatgtactgcgtatcaccggagttactatgtccccaacttctctttattaagaaagtcggttgtctactataattagattaagatcgtaaaaacataagcttgtaacatagctagaccaaattcaataaatggatttcgataataacattatgaaactgaactcatatggaagaaagcagaagcagcgggtacgtctgttcgggttcattcatgtccaataaacttcaaacaaaaggagattcgggtatcagagttgagtggacaggcgacgggaggatggatggaagagtaaagtcaagacgaaagcaagagtttcggcatcttactttattagtttcatttccgtatgatagtcacccctttctgcggagtaatgtattcctcctatgcatgtgcggtctggaaggatctgaaggaaagatttgacaaggttgatagttctcgcattttccaaatgcacaaggagattgccacagtgagtcagggaaccaacgttattgcgacctactactcaaaaattcaatcactttgggcggagtttgacagcttagctccaactcttatgtgtgactgtgagaagtctagggattttgttgcagtcatgatgtgtttaaaacttctgcaatttctgatggaactaaatgaaacttatgaataggcaaggggccagattttgatgattggaccaattccttcggtttacaaggcctattctatgcttattgagaaggaaagtcagaggactatgtctaatatttctattgccactgaaaacttggaagtcacatcattaatgaccacaagaggtggcaatggaggaaatattaacactcagaggttcaaaaagaattataatgtcatatgtaactactgtaagatgaaggggcacacccgtgaaggatgcttcaagttgattggttatccggctgatttcaaatataagaaaaggtttggaagtaacatcgcaaacaatgccatcgttgaaaaacataaaccaaaggagactggagcagacaagaactagttgctaatacaccaaaatagtacattgcaccacactttacctcagaacaatacaatcagatcttgaagtttatcaacaaggaaactctacctgaaacatcaacaaatatggcaggtaatgcatgtggtattaatgcttttttagcagatctcaaagaaaaggtttggatagttgacaatgatgcaacaaatcatatggtcacaaatataaacatgttggataagaaacaagaagtatgtaacgacctggcgttcgttctgagagttatagcccgttccctctttctgcttccttgcgtgttgttcagttgtgttgagttgtatatcgagttggtaggtttgggttcggaatagttgtggaatgaaatgaacacttagcctcttagttagcaagctaagttagtaaaaagtcaaccgaaagttgacttctgcgtaaaacaattcgaatttagatttttatgattcggttagcttcgttgggtgattttagacttaggagtgtgccagaatataatttggaggtcagtggtagaattaggcttgaattggcaaaagttgaaagtttatgtgtccttaggcttgaattcgaggttagattggtgttttggtgttgttttgggtgttccgaaggttcgactaggtccgggtgatgttagatgacttgttagtacttttggttgagaccccgaggggctcgggattgatttcgtatggtggacggaaagacttggacttggtttgagcagctatagctgctgttctgtcatttccgcacctgcagattgggactgcagatgcgatgccgcagaagcagggtcaaaccgcagatgcggaatttggcgcagaagcaaaagggctaaccgcatctgtagaaccgcatgtgcgaggaagcagtcgcagatgcggagtctcgcggtttaatgaaaaactgcacccgcgatgagattttcgcaggtgcagaaagggatccgcaggtgcgggatccctgggcagaagctatataaagcccacttcgcgaaattttacccttttcctccattgttgaacaggtttttgagctagggaagtgtttttcaagggagaatcacaagtcatcactaaggtaagtctcttgggattaactacacgcgtttatgatatttttccattgattaggcatgaaattggtagagggttagagtgaaattgagggagtcagggtttgagttttgaagagttttagatgatgattcgagggaccaaacggagtccgattttgataaattttatatggttagactcgggagaggacgaggtttattaatctgccatttttgtctgattttgagacgtgggcctgggggccgcgttttagccaatttcggatttttggcctaattatgtagttttattgtggaattcgattccttagcatatgttggtagtagtgttctggttttggttagattttgagcttttggagaccgagtccaaagacgagggcatcccgaagtaggattttacgctgttgaggtaagtaatagttttaactctggctttgagggtataaacccggagaatttcgtatcatgtgattgtttggaggtgatactcacgctaggtgactggcgtgtgggtgtatacctcgagggatggagacttggtccgtcccgtgaggcctcatggccatcattcgtgtttacgtagttacttattgttgaacttgtctgccttcatgttagagatcatgcttaggctttgttcatgctaatattatttgtactcagtcatagaaattattgtacatgtttacctcagtctctcttaattgttgatatgttgtgatacttgatgtgggatgtgtccccttatttgttgatgatggtgaggctagtgaggtacatgattgagtgagacttattgcctggttgtgaggatattaataccatagcgcgtgagctgtccacgtagcacgtgagctgtctgtgcgggtccaggtattgataccatagcgcgtgagctgtctgcgtagcacgtgagctgtccgtgcggatccaggtattgatattgtggcacgtgagctgtccgtgcggatccaggtattgatattgtggcacgtgagctgtctgtgcctagagcttgggcttttggagcccctccccagttgagtatattgagtgttgagtaatgagtgttgagtgctgagcgcgagtgatgagtgatggagtgacactgctgtgagatagtatttatttgtgtggttgttgcatttatctgtttaaatttctttgtggcaatttattgagtttttgaatttacctctttatttctatttatttttaattgtgaaaacaaataattggactgttttatttagctcgtcactactgctcagttccttagttatttctgttactactgagtcggttgtactcatactacaccctgcactatatgtgcagatccaggtgagttggaaggcggtgatcgttgagttcaggccggctatctggagactgcaaggtagctgctagcatccgcaggaccttgttactccttttattatttcttcttttagacagttatatatcttagttcatagttttagacgctcgtgacttagtgacaccctgatgtttggggccgatttttgtctttatatgaattatatttagagttgatttagtttatgagaaatttaaatgttgatattattttattaaattcttaaaatcaatcaatagtaatattttgggaagtaggcttgcctaataacacgataggcgccatcacgaccatgtatggattttgggtcgtgacaaagtaaatagaaataagacaaggaaagttcatttacctaatggaggggttgcacaggtaacacgcataggatcatgcagattgggacaagcaggaacaatagatatattctatacattcctgactttaagtacaacttgttatctgtagcaaaaaacaagagcattgaattgctctgtttgcttgttccctaatttcttagtgttccaggacctctgcaatggggaggtgagagagattggtagggaggaggatggcttctacatactacctcagactactggagaaagagagaagaataaaataacaggtttgtctaggaaaattggatgtaagattgtggcacaaaatacttggacatgcctcagcaggagaaataaaataaaatttttcattaggatatgatgattgtaagaaagaattagaggatagttctatatgtccactagttaggcatgctagactgccatttagctctagtactagtagagcagaagcaaattttcatttgatacatattgatgtagggaccatatggtgtacagacatatgatggcaataaactctttgttactattgtagatgaacattcctggatatgttgggtgtatttgctgaagttaagaagtgatgtggttgtgattcaaagaaattttattcagcttgtaaacacatagtttggcagatgcatgaagatagtaagaactgataatgggacagagtttgttaatagtgaatgtagcgcactgttccaattttttggaatagttcatcaaagaacatgtgtgtatacacctcagcaaaatggcattgctgagagaacacagaatatgtccttaaaattgcaacagcattaaggtttcagggttcaattccaataaaaatttggggtcattacatcctaaccactatgtatatcatcaatagattaccttctagtgctttggggggggggtgtaaaagcccatttgaagtatttcataggaagaagccttctcttaaccatatgaggacactaggtgtttatgttatgccaagaggatgaatgtacatgataaatttgaagccagcgcaattgcaacaactttcatgggatactcttctattacaaagggatacattttatatgatctgtccaagcacaattttttacgaactgatatgtcactttcaaagagaatatatttccattcagcagggagcaaccacacatagaccaaatatttttagagattgaaagtcatgagcaacctaaacagactctagatgcaaaagtggactcaatttcagatattgactcagcacaagaggaaataccaacaatagatatgaattttcttcctgcagatatgccacatgagagtcatcttcttgcagcaccaactcaaccacctgacactcatgaagttgctccacaaagtactgacacaactacttcatcacagatgaatctaccacctccacaagagctcagaagatctagcaaagataagggagttccaatatggatgatagattatataattccctcacagcagcaacaaccttattccattagcaattcaatatcaagcctacttgcaggctttctctagtaactgaaccaagatcattttatgaagcttcacaggacaagttatggattgaagctatgagagctgaaattcgagctctctgaagataataagacctgggtgtcgttagaattgtcaacgggaagaagtcaataggatgcaaataggtatacaaagtaaagtacaaggcaaatggcaatgtagaaaagtacaaagctaggcttgtggcaatggctacaatcaaagggaagggcttgattttcatgaaaccttctccccggtggtgaagataataattgttagagttgtagtctcgattgttgcagctgaaggttggcatattcatcaaatggatatctataatgtcttcctccaaggcgacctgtatgatgaagtatacatggacctaactgagggctttaccaggcaggagtctaatgggatggtctgcaggctggtaaaatccctatatggcctaaagcaagcaagtagacaatggaatgtgaagctgacagaagcattgatccaacaagggtttactcaaagttgtttggactactcattatttacaaagaagtagggaagcaacattgtggtcattctagtgtatgtagatgatatgctagttagagggaacaacttgcaaatgattgaagatactacaaagcagttgcataagtcattcaaaattaaagatctagtgaaactgaggtactttctggggattgaattctctagatcacacaaagggatattgatgaaccaaagaaaatatgacctggaactcatatcagacttgggattgagtgctggaaaaccaagttggactcctcttaatagtaatcagaaattcactactagacaattggatgcattgacaaggttacaaggtgatgagcctttggtagatagagaaaaataccaaagactcataggaaagatattatacttgactctaacaagagccaataccaaagacattgcattctcagttcagacacttagttagtttctacaagagccaaagtaatcacactaggaagcaacactaaggatagtaagatatgtgaagagggatccaggaataggaatattgatgagcagtaaaagagaaaataagatgactgccttttgtaataccgattgggcttcatgcccaaatacgagaaggtcagtgacaggatacattgtgaagcatgggaatcactaatgtcataaaaatccaagaagcagaacactgtgtcaaagagttctgcagaagcagagtacatgagtatggcatcagttgtatcagaactggtttggctgttaaatttgtacaaggagttgggagcagaaatggaactaccggtaaacttacatagtgatagcaaggcagctttgcagatagaggccaatcctgtgtatcacgagagaactaagcgtatcgagatcgattgtctcttcatcagagaaaaaatacatttaggggcaattcagactgtgcatgtatgctcaagggatcagctgacagatatgttgaccaaggcattaccaaggtaacaacatgaatatctcatatccaagttgggatgccaaatgtatccgcgccctccagcttgagggggagtattgagaatggtagtgtcacataatacgtgcaacttgtgtgaggtagttagctggcagttagactggttagttaggcggttagtaggctgagattgtagttaattatgttgtgtaattgctagttagtgagtagcggttaattctatataagcattgtattgtgtacaaacagattagatgaaaatgagaaagtaaaattctctccaccgactctctctagaacattcgatcctccattgttgaactctcaattcatctcttttgcttaaactttgacaataactattgcatggatgtttacttgtttcacattgtcttcaaaccaacctcaactgtgattccaatgggatccactctactaaagacggtaatgtcttacaatctggagatttctgcaaagacgaatatgaaaaccatctaggtgggcggagttacgaagaatgtaaaggggtattatcacttttagctcgctctagaaactatttacatctcgtagccaaagaagtgtataaaattatataattttgtatataacataaaaaaatatacaaactttatacattttttttactattatttttacaacggctattcaatttcacttttatctcctaaacctattcattaaggaataagcaattcttcattaaatcataagaggccacctttctcggctaaataggtcatgtttaaccatccaaaaatgaaaagcaccgaaaaaaacttataggttcacacttccctgatcattagtttgcgggacttttgcatctatactcgtatccacttttggcatattttgcgttttcacataaacgacaattgtcgccgtaaattgattttcacgcaaacatctttcaccaattgtaaacgacacatattttgcattttcatgtttaaaatacattgatgtttttccttatttgtggttaagccacattattaacagatcttctggattagaaagagtgttttacaatgtattgattgagataggttgataaaagcagagaaaatgcgtgtaaccaaagtatttaggccataattagttcaaattataaatttaatctgactgaatgaataaatagtactatgcagatattgtggtcactttgataaatacgactagaatatagttcaacatttaccaattatttcttgcagaatatagttcaaggctaggtgcgttacatttgattggggaagaacttgttctcttttttcattaatgatatttcattatcacaaaaacagaactaagatttaaagtttataaattctgaatttgtcaccaaactcatatgtccttttcattattaggttcgcagataaatctttttacatatttaataaattttctaatacaaatatggagtctataccaaagttaatggtaccgtgtttgcgaacaagtcaaatagcataatcccttctaatgaaattatgtatggcatgctttagacagaggcgtatccatgttgatagatatggattcacgtaaacacatgctcctctccctcaaccacgcataacattaacgcataacaatgttatgttttttcaaaattacttaaatatatatgcgtgaacccatgctaaaagactcctatggtacaattattatttagcgcacctctacaattgaaatttgcagatcaaatcccactttgaatggtctttattttggtacggggtgtggtgtgtgagaaaattaataaaaattcaaaaaaaacataaattttaacttgggccgattgtccatcggaaacaaccatctaccccgaggggtagaggtaaggtttgagaccacacttaagaaattttactaggtcgacatagcctgtaatttcaaatgtgtagtgagttcatggtaagagactaaagttaaaccctgtcagatgcataatcttgaaacactttttcacatcagtgcacctatatcttgaaatcctggatccgcccctggctttagagggtaaaaggtaacacatagaacacctgaacaatggtataattctaggagtgaatgtaaagtacatatagtatggacaaaattttgaaggactatagtatacttcaactcattcaactatagctaacctgtcagtgtttcaagatagacttaaagattatctaagatgcaagaaaggactaatcttgtctatatttacgttgcgcggactctccaaaatgtagccgcacccgtgtcagatccttcaaaaaatgcactacttttggaggatcctacacatatctggacacattttcggaaagcccgaacaacataggtcaacataaaaggtaatctttgaatacacaatacctattcagcactgaaaggcgaaaagcagtaatgtatttgcaatgtaagcacctatagacgcaaactgccggaaaccaaagcagtaagcctggaaagtgcatagatgactgattttagagaagggtctcttagaaaggctaaattctatgccatttccctcttctccccttctcatccagtagactaatatgcacataaactacaacataagcattgaaaaaatgattcacaacgattatgcaaaaaatttaagaagctcggtaagcagatatgccgacaaagaacaacaaccggccagtaaacttctcagataaaatctttttgtatcgctacagccaccttggcagtcaagatcaaaggtactgaatttcacccttctcttggtacatgtagcctttcaaattaacacactgagcttatataacacaataacaaggataatatgaggcgctaatctcaactatagtcaattcaccctaatcagctatcactagagtttaagcattaacatttataaggcaacaccgggataaaataggagcaaatctcacattgcatatgccaacttaagatgtttatagccaacaaaatcctcaatacaacgactaaacgcaggtccaaaacaaaacataaaccaaaataaatctaacaaaatcaatttcataaagagtattttaaacatctcacagcctaaaagacaagctcatggggtttcatgcccgacttgagggagaacctagcagacaaataagccttcaattcaggaacacattcaacggccttgatcaatgcttcatccacagctttctggtcatccttcttttcctgaggaagtgcattcttttcctacaaaacacaaacacagtaaaaagagatcagaacaaccacaaaaacaacgcctataaatcatccctgaccatgtttctccatttaaattcatctcaggcctaaagaaaagatcaaatcaacaacaaacacgcctcaatcactaacaagttgggttagttaatattaatcatcactaaccacgttactccatttaaactcatcccatgacaatattactcacatacataaaacaatcatgaaaaggcaaaatcactcctacaaatattaggacctataataaaagtgcgagcgtctaaaacatagtttattcttcattaatagaccgtttgcttccaatgtggtatatcctttgagaagtctgaatcaccaaacaacaaaaataattattcactccctaatcatacaatgaataaaaatatctaatcgttacgcatagaatgaacaaaggatccaacccataaatccattcctaaagcacagaatatacagtctttaagcacagattgaaaaatagaatcgatattaatcagaaaaggatcaaaaggatccaatctttaagcatataatgaacataaagatccattcattaaacataaaatgaacaaaaagacacattcttatacacaaaatgaagagacagattcaacattaagcataaaatgatccaaaaaaattaaaatttcagcttaaaaaaacaaaacaaacctcttttttgtcttcaaagaactccccttcacccttcttctgtttcttctcagcttgcttagcaaaatacttatcgtcaatcttctcaacattcacaccagaaacatccactttagttgaagtaccaataacataagcttgattcacacgcctcaatggaactccattaaacttaaacggtccactaacaagtaaaagcccagatttaagctgtttcaaaaacacaactctcttacccttaaacctaccggcgaggataactaaaacagtaccgggtgtaatacttgctctgagtttcgtaggttttggtttgtgtttgttgacaagaggttttgccacgtcatcggctgggtaaaatttggatggtttgacggccggtggtgcggcggcggcggtttttttgtggacggggaaagagccgccatttttcttcttgattgcccatagaccctttttgtggtacatcttggaacgggaaagttttcccactccacgaatcagctctggattgcggggactcttctttgcggccattgctgaaagtttgaagctctctccttagcaatttgctgattcaataaaaccctaaacctagtaatgtgattttatatatggagcagtgagggtttgtgtgagagtgagtgagatctgggccttttgtttctgcatatggggctaaatgggctaagagcccaatttcttatatgggctgggttagatgataattatttggggcttttgcatctatatccgctttttaggtcacgttgtaacttatacccgctttgcaaaaaaaattgtaagcgtacccacttttcgcataaacttcaagcaacgggcctgaagtagcaaaggcaatcacacaaaacttcagcattctaggctttttcaaaaacttcagcagaagtgctgaagttatttagttcatttgtaaaaacttcagcactaaataagctgaagtttaatgctgaagttatttagttcatttgtaaaacttcagtactaaataagctgaagttttgtcctgaattaattaatttgtcataaagttttttcaaaaatttcagcagaaaatgctgaagttatttagttcgttttcaaaatcttcagcagaagatgctgaagttattaagtgcatttataaaaacttcagcagttttgcacaggtatcaggaaggcggcgcctgaagttgtaaaaattagggtataggttaaataattttaaaaatatgggtataagttaaatagagacgaccaaataggaccgcccgcccaatttttactaattatttgctaataagttgactattcaattgagaaattttagccgctcccaatactaatagacgacaaaaatgtgtatttttttgtaaatataagtattatatataaaaaaacatttttacatttttccgttagcaaatataattagtttcagccaaccgtccaatttttattttgtccaattcatttgtatttcacctttttttttaaagttcaaatcatgaaagtattcttaactactcaaatggcgccattaactagaaaatttagaatattaaaatttgggagtaataaacgagctaaatggcagtgtcagcagcaattgtcacactaaactaagcaacttaactttaacaattactccctccgttcacttttagttgtccactttagactttattcttcctttaagaaaaaatatatgaagtatatatcttacgattttacctataataacaatatcatttccagaagtcttgggaaattttttggagaataagctgataaagataaaacaggaaaaaacgattatctttctcttgatttagtataatgaagaagtaaaagtgaatgtatttttaatttagtggacaagtaaaagtgaacggaggaagtaataagttacatatcacttaatcatggctgagtaataaatgcatgcatgtaagacaaatatctcgaattaatgtaaacaccaagtgtggatataacctttcgaactgctgctgaatccatggacaagcaagagagaaccaggcgaactgaaagatcttagtagccaaaggaaaagaaagcaaaagcgattcctgtagtagcggcgggcgaaatgggagctgcctataagcttttatgatacatccctgcttaaccatctcagaagaatagcttcaatattatgagaaatatagatatcttcatacagtccaaggttacaactcaaatatataatatccagcaatgtggagcaacagcaagctatttcttaaataagtgaaaacataaaaaagattaacaaccatagtgatacagaagttataggagtacaatattcatctgcatcataaagcaggcaaaattttctatggtatattggtcagttgagcaattaaggaaattggtaggaccttccattaggaatccatgccaaaattatgtcagcatcaaggcaaaatttctgcaactccacatgcagaattactgatttttggctttgttgattagccattttgctacttgtagtggttgggatcttctttgctctggataagagggacgccatcttggcgccacactattctctcttcacataatgcagccgctacttccacgtatagtttatgctcctgctaatgaagtgtgttagcacaaaatgttacacgaagaaaaaaaaaggagcaacggacaggcaatcgaacaaaagtgagtgttgatgaattaagcagaactgcaagccccaagaatgcaagtagtaactaatatagaaaaaaaggaagaaagtgagacaccccaaaggttaatttttaagcgcaacatgaagtgttcaacttgattgcgacaacaataatattactcattacaagaaatgtgtaaaagaaattcatgacctccttaagaacccttgctgcaagtgtatctgcggtgtcgttagccagcacaggcaccacccgttgagcaagaatacgtccggtgtcataatgctcatcaacataatggattgttggaccagaatacctacagtttggcagagagcagatagacaaatgagttgcttatgcttggaacttggaacttgaaacccgtagacacgtgtgtaggagctaaaatgaggatccaaagcattaaagacagaaaactaaacccatcccaaagcagctactgagatcaaagttaggtgcttactgctgtaaaggtggaggacataaactaaaatatgcagcaactaggtcacaggaaacaatacaacaacaacgacgatgacgacgacccagttaaatcccactagtggggtctggggagggtagtgtgtacacagaccttacccctatattggcatgaaacaatgaagtaaacaattaatcaccaattctggtcaattatgatacgaattgtctttaacaattcatgacaattcactggaaattccaagataatggagtaaggacactcaactcaaaataggggtctaaatctgcatggtaaaaactagcaatagaaaggtttgcttggagaatttggatcctcaacatttcaacaaaaagatgccacattgtctgataagatcttaaatatgttcccagatcacatttcacatgcatttaaatttcataaaatagaaatagatacttcaaatccgaaagcaatggattaagtgattgttggtatttaacttatagagaaaacacaagtcactagagtattagctcttcaactaagcactcgatttacaatttacgagctgaatggtggtgcctcctgtaaaagaagagctaaggttgcatgttttgcgatatttggacaggaaaattcatgccctctatagagttgtgaaggaatgtatatcttccatcaacagttattacaaacatgttttctgaagagtgaataccaatatatctcatgagctcattccctttatgcagggattccaagaaagagctagtcatatcatatgtacttatttgaattatggacgaaaactaaagtgtgtttcaacttggattgactgctctttattggatttcaggagttcactttccaggcattaggcataaagcaccttctgacatctactttttctagtcacttatatgattgacttggatagcatagtactctgaagttggagttagcaaccaaggggggatccatattacgagcattgatgtggctgctttcgacttccactataaacgtatagctgaaaattgttaaaatgtatctgtgtgtgcgtctaaagtaaaccgcctttgctaatcctatttcaggacctgcctttgctaacaactcgacatcatcaatggacataataagtccaattatatacagacacgctttcaaatatggtacagctgatgcactattcagatcagaaaaatagctgttgcagatcgatggattagaagtctcaatttagagaaccccatttaatgactctagtaacaaacaagaaatgacttaatacaactttctatggggcatagaagcagggaagcttcttgttggccgtcagtctccagccaaaattcaaaccaagttaaagagttaaataagtttgcaggtgaccattaccctaaaaaaggcaacagaaacagaacaaagtactaggagtttaagtattatttcagggaacccataacaagatgtagaatagttggaagcaatgacaaggataacatactggcttataaacccaaacattttggcaaaaagaaacaataaatcattggctgttactgaatgctcaagcttactaaactaaaaatttccctcaatccaacctctttctctttagaataaaaaaagttccatatggtccagatttaaattaagctatattcctcatcattgcatgtgtcctaaaacattgcacagattaataatctctctcccactcgcctgccaccacctcccatcaccactaaaagaaaagaagataaatatcatattaaatacttttttatacggtaaggcaaaaatgaaacaggtactgaaggactattagtgttcttaaaagccattgcttctttgcttaaagcaatgaagtgatgtgaagtgaaagttcatcgctttatgggtgacgatatgtgcttcagagaagtgtgcgcttatgagccgagggtctattggcaacaggctctctagcctcacaaggtagggataaggtatgcgtacatactaccctcccagaccccacggtgtggaacaatactgggtatgttgttattgtagaagtgtgcgcttcaaacattgatgcacaaagtgatacaaacgagaaatgacctattctttaagctggcgtttggccatagattcccaaatttgttttaaaaatctgttttgggtgaagtttagtttgaagatgaaaatgtgtttgaacgtacattttcagaacatatttcccaaatttattttggaaaaacatgtgtattatgaggggtttggcccaaaacaagctattgagctggttttgggatttgagatttgggatttggggtttgggattttgccaaaatataggcaaaacttatagccaaacatgtatttgccaaataaaacctaatgtttattttggcaaaatctatggccaaacgggtccgtaagtctcaaacttgaggagttcgattaagtattaacaatagtattgtgctattggatattgaacttagtaatttgaatagaatttgattagtatagtactaacttttttttttgtttgtgaaatattttaagagattactgtagtactaaattcgtatatgtatgatattttgaaatttgtcataaattctgtacttcactccttgattttcacttcaaaccccacaaacctcatagctattttgtgccttttacttttaaaaacgttggactactaggccttccaggcctagttaagaatctcaaacacatgatactttaaagacaaagtatagtaaatggcgcctgaaacaaacccttttcagtacatatgacagtttttctttacctttttacttatcatggcagggtaatttttttagtttgaagttaacaactgaaaaattaaagagaaaggagatacaagatacttgattaacaataataatttcatttttatagtaaacacattacatacctagctccagaagcaatgactgctttatgcaccttcatgccatagtagcctttgcctccaaaagctggaagaagtgacggatgaatattaaatattgatcttggaaatgcttggaccaactcagtagggataagctttaagtacccagctaaaagaatgaagtcgatattgtaggttctgtaaacaaatgttattataagatatctgggaagaatatgaagtaataacttcagtaaagtaagggagagaacaaagacatcaacttaacggggcacagacagggttttcacggtacaaaaagctaaagcatataacttcagagagcaaagtcactagataattcatgtcatactcatacactagttaaccaaccaatccccttttagatgatttatctatggtcattcaggtgactaataagtgtgaaaagtatccatacacagagaagacagcataataccaagcaatatttttacttttccattttttccgtaatcgtcttcttgctccaagtagaagaaagcaagggcaaaacgaaaaggatgaccaaaaataaaggaaggtgggcaaaaagagaagaactcaacagaataactctatagtttcaaaaaacaagaagtagagtccaaataggtgaaaaatttacagtagtttgcaggtgagcagaagaacaacagtgaaagaaggtgacaaaaataaatgcagatgagagaaaaaaagaaatatttgacagatgtgcagcttaagaaaaccaaaagcatcgccatatcaaccacaaagaactaccatatcttaaaccacatctatcttttttatatagaatcttcattatatctcaaaatcaaatatcctcagcaatcagtagcagtacaagtatatttccttctattcagataccatttttcgcctgctaattagtcaaaaagaaaaagagaagaaaaacgaggagttgattgcggcacgacataatttcagggaagacaaaatcatttttgcacaaaatacacaaccgctcatatggtcaggtcaatagaggagttgtggatagataagaacagaaccttagagcgcctacgagatcctcctccgacaaaccctcggatttatcctttgctttaggaaacaaaataacagggatgccttgctcccttgcatactttgcacctccacaatctgcatttcattacaaaaaatatctaaatgaaagatgagtgacaaccaggagaagacatatcttcgggtataaactgtgctaaatgtgagttttagacatttcaaaagctttactgagtaattcttcaaaggatagataagcacttgaaaatcatgagtacaattctaccaatccatatattcacaaagttatccatgctacaagcaaaaataatagcataagggaaactttagttgaaacagaaatttctgaacttttcaagtgattccaccaaaaatttatcaagctgatcttttatcgagaaacatctcaacatgagcaaaaagaaaaaaaaaattggttgccaatgatttcaatttttaacatagcagaacacattcatgaagtcacagaataataaaatatcaggaagaaagaaacaaaagaaggaatacagatgaaggctgatgtaacaacttaaaacaaaatttcattctttggctaattaatcaacacggttgcaacataaataggctgaatatacaagttttcactaaagctcagagctctactaaaatctcaaataggcaggacgcaaaaaccaattacaaataatcttgcatcacaacaataacaacaactactgctacgccgccttagtctcaaacaagttggggtccggctatatggatcatcactaaccatgttactccatttaaactcatctcatgctaatataagcaaatataagtaaaaaattattagaagttctctgtataatctgaagtataaatctctgaaaggctaaaccgccactagaaagcatatgacctacactataagtgctaacatctaaaacataatctcaactaatatgtatcgcctatatacacctacacaatttgttaaggctcagagctttaaaaagatctcgaataggcagggaccaaaagccaactacagataatcttgaattatgacaataacaacaacaataacaattacgccttagtccgaaataagttggggttggctatacgaatcctcacaaaattattactccagttaaactcatctcatgctaatattatgagaatataggtaaaaaatattagaagtgttaattgtctaaaacataacctcagctaatatgtatcacctagagcagcccggtgcactaagctcccgttacgcacggggtccagggccacaagggtctatcgtacgcagccttaacctgcatttctacgacatttctgcaagaagctgttttcacggctcgaacccgtgacctcctggtcacatggcatcaactttacagttacgccaaggctacccttctaaataatgttaaaaaaaataatccagtgcactaaactcccgcgggtccagaaagggcggaccacaaggactcatttgataaagctttaccaaaatctcaaataagcagagaccaaaaaccggctaaaaattaaatcttgaaataagcagaaaaataataatttcccaaaaaccttaccatgtttattggtgactagaacagctacttctccatgaactgtaccctcaatagttgcttcataaattgacctgaaatttgaacctccgcctgatacaaaaactaccagattcttctttttaagttctttgctcccactattattaggaactgtaacagattgtttttctattccttccaaacaatttatacactggaaaattttcttaggagcaaaagaaaaatggggttttaagaaaaaccctttaaggggaagattatttggtgaagtataagaaaaagatggtatcttaaagattggatatttttggttttgaattggtgaagtggataaagtggaggaaagtccaaaagacaatctttgagcttccattcgtgacgtagcagaagggggggggggaagtggaggtgaccggcaatagtggcggcgggaggaggaggaggaaggcgggaagaggtggtgcggccgagggaaatgaatttttgtccaattattatttggaaaatatagtaaaaagtggaactaaaacggtgctaaaaaaaggaaaaaaaaaaaaatttataatgtggtgcttttttattttcttttttgataggatgattttctcagttagcgttttttcaatttttcctgtcctatttaggagtataattttttgtggccaaaagtagatatattaactatttcccttgatttaaataattaagatattaagctaacttgtaattaaaataattggcaatgcaaggaaaaaagcaaagtaattctgaaaatgacagttggacgagaaagtgcatcaaaagataattttgaataattatttatgtttgacttcaaaattgtgtaaaagcaatataaaatttttattactacttgaataatgacattgctcaaatgtaggtggttatgatgcaattgtatttacatttcaattgaaatggcctcgtggtcactgaaatttgtacgagattttaaagtcgatatataaattttcattgttcctatttgaacactcaaactcgtatatttaataatttataaacatatttgactgttgatcatgcacatgtggcattgacaaaggtgatatggacaaaatatatacaaatcacgtaaactaagcgcgtcactacaataattttggattaaaaaaatcaaaataaaaaaatacaaagaaaagaaagaaaataagccccttctccaaaatcattaaacccctattcccctctcccatttctgtttcttttccttgttctccatcatcctctgtccttcctttccctccccccccccccccctccttcttttcttttttccccactccaatctttccctgtttcttcatatgtttgttccaaacccaggtagcaatggtgcaaaataaagaaaagcaataaattttatcaaaatttttctgtcactctttcctctcatattaattccctctctcctttttgtatccatcttaaactggaagacagatagagaaaagataaagaccatcaagaaattggcgatttttgggtgaaaatttctaattacacagtccgacttcttctatgttttggatttcaccattcgtgttcttctttgacatagtttcgccggctttttttcgcctcaacggaattttagaaggtggcacatcgattctttgacttgtgattagggtatggattttatgaattttgttagaagtgaaaaatggttgattttatggatgttcatggctgattttggtcgttctattgattaaaagagggggaccccaacctgttggggtttattttcgggcccttgacgtgtaacaatctcattggccatttgctgaatggatggacacgtctatgcatgtgtaatacacgcgcatacgctcaaggatcaaatgtgtttattagttaagagaatcatgagttcgatgtgttcaaatgggaaaatccaaagtttgtgtttcgattttcaaaagccctataagtttaagtggtcaggaagtcattacgcctttcaattatatgaaaattgagaatggtcctaatagtttgtttggatggttgttacatatatgtaaggccccgtaaatttttaacaaaaatctgaaaattttgtagtgccaagttagatttatgtgtcataatactagaaagctcacagcagttcggactttttggattgaacagtatactacagacatagaggaaaatgttttgcagaaaaacgtgtttccggtgcccattatgcgaccacataatcactctgcttgcccgtcagtctgtggatggtcttcgcggaaagaatcatggcagaagctcatacttatagatattccgtgcacccaggttctacgaaaatttatcatgatctcaaggaaatttactggtggaatgacatgaagagaggtgtggcggactttgtggcaaaatattcaaactgtccgcaagtgaagaccgagcatcaatggcccagtgagttggcacaaaatatagaaattccaatgtgaaaataagaaatgattaatatggattttgtggtggggttaccgtgcactccgcgtaagttcaactcaatttgggtaatcgtggattgactcatgaaatcagcacacttcttactagttaaatccactgacacttctgaataatatgctcaattgtatatcaaagaaatagtcaggcttcatggcactccagtttccatcatttccgattgatgggcccagttcacagctaatttctggaagaaatttcagcaaggtttgggtacgcatgtaaatcttagcatgcctttccatccacagactgacaagcaagtaaaacggactattcagacacttgaggacatgttgctgcttatgtgcttgacttcaagggtagctgggatgatcatttaccgcaataaaatttgcttataacaacaacttccatgccagtattcagatggcgctgtttgaggccttgtatggtaggagatgtagatcttcgattgggtggttcgaggttggagaagctgaactaataaggccagaccttgtgcatcaagctaatgagaaggttaagatcataaaagaacggttgagaactgcccaaagtcatcaacaatcctatttggatgttcgtcgcagagacttagagttcaaagaagatgattgggtgttcttgaaggctctcccatgaaatggatcatgcgtttggaaagaaagggaaattaagttcgaggtatgtcgggcagtatagaatcattcaaaggacagggcaggtagcgtacaagcttgaactaccacctaagatgtcattagcgcacccgatatttcatgtgtccatgttgaagaatgtagttggagattcgtccactattgtgccggttgagaccattgaggttaatgaataattgtcatatgaagagattccgattgccattcttgatagacaagtccgaaagttgagaaacaaagaaattgcctccgtgaaggtattatggcgaaaccagcaatttgaagaagctacttgggaagccgaggattaaatgaaaaagaagtacacacatttgttcgaatagacatgtagtaactctatgaagttgttcccataaattttgtatcacttgttcagctaatgtaaaaacactccttcctagttatatgttccttgtgaggcctcggttggtgttgttttgtgtcctgtcacgttatttgaccatatatatgttgttagatgtgtttatggggctctctggcaggtagataggcctagatacaaagaaaattctagcgaattttttggaaccctagggagtaagccaaatttggggttgatggtatgtggtgtgaaacactaaaactgtataaagtgctgttaagtcaaccttgattctcatttgaggacgaatgatcttaagtgggggaggatgtaaggccccgtaaatttaaatttatatgtcgtaatgttcggactttttggattgaacagtacactacagacttagaggaaaatgttttgcagaaaaacacgtttctacggcccatgcagccgcataatcactatgcagaccgcatattttccacagagtgaagcagaaaaattggccaattttgaggtcaattatgcgatcgcataatcgctttgcggcccgcatattgatcgcatagccaccttggacttttgtgaagggaagttctgtggtgcattatgcgatcgcagaacaggtatgcgggctgcatactggtcgcatacccaggcagaaaaatcaagcccctgacggctatattttgcggtcactttgcgggccgcataaccattatatggttgcatatgcgatcgcatatttgtgtcgaggctcctagtttttcaattttaaaacccgaccccattctattaaaacaccccattaggccatattgaactattttcttacatttctagagtgagggaaagggttcttagggagagaaaggccaagcatcacactaatatccttccattcttactaattacttgaagattttcaagagggtctccatatcaaaggtaagaatctaagcctagctcagcatttcgaaaatttcttctaaaataggtacctagtaagataattcatgggtgtgggcttaattgttttgcatgcatgggtggtgagggaacctatgattaatgtaagctaaaaaagacggttaaggatgggaataggctaagtcatcgaccgtccttctaattcttgaatcaatttgtgataatcctgaaatagattgaaggtgctaaaggtcccggaagttatcgtcaaacgcaaggaaagctattgaggcatgtatggctaaaaacaccctcttcttaggaatcgaaccttacgattcccctacaattagtttaagcctcaaccttgattgatgtaagaaatgacactccaaatatgcttatgttgtaagactttatgtgcaataagtatttaaatgctccccatcatgctatttgctacttggtgatgtactgaagatatggattatgtattaaattgccaaagtatgtgaaaggctctatatgcccacaattcacgatttctcatatcttgaattgaaatgcttgttgacgaaattgataataatatgaaatatgtggaaagaactcgaatcatgaaatgcggccaagtgccaagtatgaattaacaattgtgaccactagcacttaaggaattgaaatatgtgtgtgaaacaaggagtgagatgatttatgaaaaatgaaaacgtcttgagtaagacgggctagccgattgggccgtgatcggataccatgccgcacacaatggtggtaatgtgctgggaatcgaaccagaattgaaacaggaaatgatattgtggaaaatgcgtccaagggagatgacctagccgatcggatcgtgatcggactccgtattagagtacaatggtatcgtgaataatgaggtgtaatgctaatgatggcccaaactaaggctatggtaatttcacttgaaagcttatgtggttccttgtttgatgttgtggtgttgtctgagtttctcattgtttccatgattactccttctagtattattgctctttctaatgaaatggtgtttagtacatactagtactaatcaacagtactgacgtcccttttgccgggggcgctgcatctttgaatggcagacagtgccgatcgcagcttgtggcgcattcccttctcagtgatcttggtgagccccctattcttccaggagttatgatgtacatcttttgcttgtatgcttatacgttttgaggtatagttggggccttgtcgccggcattgtcataactgtcaagctccgtagacatttacgtgggttatgtatggatattagaacgggggccattgaattatgttgtatttcgtctaaaactcctattcttcttatttgtaaattgtatgtattttggggacttaaccttgatataatgaaaatgaagtaagtaatttttaaagttctatataattcgtctactccttatctaatgacaacatgccttctttaatcacaagcgagtcaggtagtagtcatctaataggctggcgcgaccggatcctctcgattgagcgccggtcgcgttccctgaggttggggcatgacaatatcgtttcataatatgtcgtatcgttattgtattgtttatatatgaaaaataaacttataacattatagagaaaagttatgatatgaggtaaaattgttatataaaaaggtaggataaatgataaaataaaatttttaataacaatgaagggtgagatgagagaaagagacaaggtaacgacgtggccataccaaattggttacataaagtggcacatttcaccgttacgtaacgacagatttagcgatacgatacaataaaatttaagtaacaatcaaaacaaacatgatatttaaaaaataatacgatacaatataataggtaacaaccaccaaacaagctttaatgtgttgattattttaatttactttcaagcatattttacttcgaagacatcttcaattttttttagtaataatacatttggtgatttagatcaaatttgtcaacataaattgtaaaaaacaagtgttttgttctttaaaattgatagctttttagactttatgtgatagatagtagtactaattatgtgtatttttgccgttatttctacttgtttaaattaccttttctttttcagttgttctctagtcaaaagtttatcggaaccaatctatctgtcctttcagaagtaggggtaaggttgcgtacattttaccttcctcatacccccgaaaattactgaatttgttgttgtaattcttcgtgttatcaaacgtgaaccgctcctaaaccaattattttttttattttattgaatctcgataactcaatcccattttttgattgaggataaataagtgatctttataatcagcgtttcactataaatatgaaatatgaaatataagctattatcaaaaatatggataggcgatcactaaatatacataggtgacactagaatataacttaggcgatttcattaataaaaaagaaaaaagaaaacaaaaatctgtaaatgcaaaaataaaaaatgcaaatataagaagaaaaggtaatataaaaagaaaaagaaaaatatttaccaaatgacttattatcagatttgacggttcagattgattctaaattccttatcgtataccttctcacacttgataattcccaaaggctagtaaaaccatgaaacgtctctcagaaagctaaactataaatacccgaaaatcaaaaaaattaaataaaacaaataaacaaaattgcggatcggaaaagaatacatcgccgtgagtcacgactgatccgccgccgtaaatggaaggagtaggggctagatttggccggtcatcaactaggtacggtccaacaactgtatttaccggtccggttcgtagatggaagaagaagtggatccatattagctcaaacaaaaacaatcatcaaacgacgacggcagctgctaacggcggagttaacggcagtaatggctctcatcttttgcttttgaagtggagacctattactgccagccaaaataacagtagcgaggaaaaggatggcgattataacaaagacgaagacgttccgatcgaggaaccacgcaagcgaaaattcaagtttattccggtaataaattgttaatctttttaatttttgttttttaaattacttaatttgagtgttttttagagatcaaccgtatatatttccctgtatatagtcagaagcggatgcaagacattggtaccgggttcaactgatgcggagcataaatttatgtgtaaaattcaataatattacaatatatagcaatatgagcccataactttaaaaatacaatgagtacaatatatagcaatatgagctcataactttaaaaatacaatgagttcaacaggttgaacccataaaacttaaatcctagatccgcctctgtatatagtatttttttgacgacatgttgccggaccagcttgcccggacctcaactatttctgctagctcctatcagcacatttatcggataaatatgcactcgaaggattagacggatgaaaaaaagtcacctcataaattttaacatgtgatagcaagtaacttaatatttatcaagaaatttacctataattacctaataagtaacctaattgtgtaaatattttttgcattgtttagaatttaaacatataaatttataaattttcaaggttttattagttttattttttttattttttagttactgaatttgattgcttagatcatctaagtatttcccccatctaattgcattagtgtctataattcatttcttatatgtaatactaattgataggacctcaatggtaagtgctacaagatctcgtgcattggaaccatacgctctcacacaacgttgagctatttcaacagtctattgagtttgcttttctatttcgtgtttttggattattttttttgatgctgtgcaatttgggaatctgattaaggggaattgattggttgtggtacaactatttgggtactggatttgttgaacaggtttaagttttatacattgagtagtatttttatgctatctagttacttgaaagcaaggtaagtggacttctgcaaccaattaaaatataatggagtaacattgttagtgtatttattttaaaatcttattgatatagggatttgaaaaaaatgtctagataatgtattcctggttggaattttggaaagaagcggagaaattggtttaattgatggagagtaaagtttacggatctgccttatgttttgtgtagatctgacatcaaatggcatgctgtgggctgttagatatgcttttgattaaacacaaaatctaatcgtgggttttaaattgtgtgatttaggaaaatacaagttatttaggttggcaagatgtggatctttcactgataaaagaatatgtaaaaaattccaactctattgaggcataagatctatagaactattgtacttcttaggctgctttttgatctagaaattggttctggtggtggatatatgtctcattgatcactaaaacatttttgaatagtcataccttacctactagataaaaaagtaagtttttgttgacacttgacggaacttttaagctatcttttcatctccactggaagcaacttctttcctgtctctcatctcattttaaatcaaggatgcaagacaaaatctttctctcttgtccgtctcttgtccatcaaatacggcggaagcagtagaagtactcttagacctccatatgttgttctcatgttgcttgttggtttttcatgtcagtgtggagactagctatatgcttgagagaggagagggaagctaacataagctttcacaaatatgttctggttatagtgagtctattagcagagagaaagagtgagagagaccgagagtgtgtaatgagcttgatacctttaattactgttcctgctttgttagtatggacacttatgtgctttttgttggtgtttgaaatctggagagatgattaacttgtagaatttcctttagaagctattatattatgcaccattctaggtgttatttactggtcccttatgctgagatatgctgagatttttgtggccaattatgcaattgagaggaaaactctaatttggtttcaacagcatatttctccaatgattgtaaaccttatcttatgcctggtggatataagtaggcaatgccaaattaagtcagagctgctaattaagagtatacggcttgtcaattttctggtcgaaaagcttacgtgatctttgatctttctttccgtttggaatttgaatatttatccttccccacgttagtaatcatcactcatcattgataagagtggatacggtgcttgtcacttaccacacctaataccattggcagggtggtcttattgctgtactcgagtaatctgcggaatgccaaaacatttaatttttttattttttccctcatcaggggttgcttctggtgcgtcagtaaggcaatagctttggtctcctcgctaagtgataataatattcatgtctggctgcatcttattcattaatccctagcaaaaaagaagtgataatgaatctcattttcaaaatggttgagatagattgctgtgcttgaagatcaaaagtatgagacgtcagaacaggatgaggacgaagctagaccaatggaggctgatggttgtgatgaaaaacctgacatcaacaatttgctgatggaagaaaatcaggtactttaaaccttctcctctcccaatgtgaagaactacgatagagaaaatgctaagggaaaaaaagataagcaacataactgactgttgtaacttgtttattagtttgttctgttctcactcgttatacaaaatgactagtatgaaacttttaaatttgatttggggaagacatgaaataatggtttttagtcttttcttgctatttgtttccacaactttgaatcgagcagtggacttcatacggcttaatattttgtgtgtttgcgtaacacaggatctgttcgattcgtgaaaacacttcctatctccattcttccagcatgttgtagcctttttgtgttctcaagtttctatattatttcagattattttttaaaggttgtttaaaaataacagtagtattggcatgcaatgtcgcttactgttggtagtaggtttttatgactaaccgatatttccttcattgttgatcaccttactttttggttgtttttattctgatttcatatggcttcttggtattgtcccttcttgtctatattttcattaatgtggtgcttatattttcctaagccgagggtctattggaaacaacctctctgtcctcacaaggtagaggtaaggtctgcgtacacactaccctccctagaccccacagtgtgagatagtactgggtatgttgttattgtttaaaattttcttgagaagttctcttcttttttaagccaaaaaacaaggtttcccctttcgcctctttcttcttcgaatgagaacaatagaaaacctgttatcaaccaaacagtttcatcttttcttgtatctttctttggtttgttctgttttgtttgtacctggtgtcgtgttttttaactttggtgagtataaagccctggagtgttttataattgtgttgtaatgcatcaggatccacaggataaacctccagaaagacaagatctaaatgaaagcactttggacttgtctttgggcttgacgggtcttgacaaaaatgattctgactcgaaaatcgatcaaacaaaataggtttaatttgacagattgaactccagtagcactgggtcatgatatcttttctgtaaatgctgctcgtatccgttggacgtcttaactgaattggtcctcacagttgacaatggcctagaatatagtcactagaaagttttttccctattggctgagttcatagttttttctcctgcaatgtagtaaaacactatgacattgaacttctttgaatgaaatttaacgtgaatcacattgaagaaattgtttgatttcttatattctattttcaaatgtatgcatattcatgtcttagtgagcaaagctgttgcttaaatcttttattataagaaggcagaatggcctaaagggcacctatacttgtctcactttgtcatgccggtctccaaacttaacaattcgccagaacacttacactacttcaaaccgtgtataataaacgttatgacacgaggttgtcaatgcgtgtaatacaatctcctacacgtaggacaccacgtcaagaaaattaagcgatgtaggctccaagtcatttattatggccgcataggaaaataaaacaggaaatgattattaccctccaaaccatcctcttgttttacacttacccgcttagttaaggtttagaaagtatgaatcacttctgtctctcctctgtcatcgttgccgggatttttatgtccaaagcccacttaaatcatgtctgcttttgcttttgtcataaacaagtgccgttggttttttttttttagaaaatggaggaaaatcaatggcggaacagagagggcaatcacccttctaatcaaaattccaatattctcaattttgcctcatttctttctgggttaaccctttttacatttttatgggaaattctcgtggggttttcgcctcccaatttcaaaatttaacggaaaagagcatgtaggtttgcacttaagaaaataaccttccaattgaggctcagatctataatgttgaagacaaggcaagagattggagacaccgccatggctacaaacaccggttgcaagtcagtcaccgtccggatcgccccgccaagttacaactccgattgttcccttgccctaatcaatttgctcagataccgaagaaaaattatcatcacaatctcagatttttgctacaattattattcattcttattttaatatttttttcttcttgttttaattatttctagttcaaaatatttatattcacgctcgttattcgcgtgaattatacccacttcgtctagctcaactattatttttttattgtgtttgatcaacgtcagaagggtttaaataatagagtttgatcaaattaaagtgtctggatgaaaacaagtgaaataggaggactgacataacaaattgggacaaagtataagtgtcatttaatccattctgcctcataagaaagaacataagttgttgggtggataaagcaaatatttcctctgcatccatcgggaaatgttttccctcaagttgtcgttaacaacttgtttggatggttgttatatagtatcatttgttactttaaatacaatgtttgttttgactcttaaaatttattgtatcgtatcgttaattcaattgttacgtaacgacgaaaagtgtcactttatggaacgacgaaattagtggtgcggtagcgttgttaccttgctttttttctctcatcctgcattccttattattaaataattatattttattctttaccctattcttttgtataataattctacttcgtatcctgcttttttcttaataatttgcaagtttattcttcatattgttggtgcgtgacatcacgaaacgacgacaaatgatacaatctattcaaatattgtaatcatcaaataatacagtataatactgtcaatataatacgatacattatgaaacgacatgtaacaacaatccaaacaagttgtaggaagcaaaattgcttttgtcgacaaggattgggttgagtggtaagagcacgatagatagcgtgtaatgtgaaggttagatgcatttcacgggtatgaatcctgcctagaacttaaagactagtatttaagtagaaaaaggttgagaggcgttctcattatccatcgtgtttcaaatcgtgcgctttatcctagattatcctgcgcacctgggaaggcggaaaagaattgaggatcaacgctgcattatttccaatcctatatattataaaatccagttagagctacttttcgaaatggtgaaatataatacagtcagacctctctataacagcatccctatataataaataattctttataaaagccaagatttttcggaaccaatttttatattatgttataatatatgtactctacaacatccaaaaatattcggaataagcgaggctgttatagagatttttgactgtatacactatatttcaatagccatctcccgtttggtgaataaattttacatgtaagctcaaatatagtgaaataagttagcataaagcaaagggaccatagattatacagcttaaattagttgtttgtggttaatgacgttgtggagtaaacacttctcgtaaatataacttaagatttaaaaataaagttcaccgtgccgcataagattctcaagtcaaccatcactggcgaagttagcaatttcttcaagggcgtttaaacttgtaataaatgaaaataaatttccgataaagagtgttcaatatatgttatatacctctaaacctaatattttacctatatatataatgtaaatttccgacgaaggatggtcagttgaccatcctataagacatatgccttcgcccgtttgtacccaatggcgaagtcagaaattttctcaagggtgttcaaatttgcaataagtgggaaaaatctctgataaagagtgttcaatatatgttatatacctctaaaacctaatattttacctatatacacaatgtaaatttccgacgaaagatgatcagttgaccaccctataagacatatgccttcgcccctgtttgtacccaatggcgaagccagaaattttctcaagggtgttcaaacttgcaataagtgggaaaaatctctgataaagagtgttcatatagtttaatacctctaaaacctaatattttacctatataacaggtataaatttccgacgaagggtggtgagttgaccaccctataagacatatgccttcaccccctgtcaaccacgactaccatttctggtccattttctttttcttccctgccgagaagggataaaaaaaagtagcttatttctctcctggatggatggcgacttaccaaaatgccttctcggtcgaagaccccttttgactagtaaggagtaaggacgctggaagcaacaaaaactttgcgtgaagtacgtttcttctctgtcctctcctctccaaaggctaagggagagaggctccatccctttccttcaatagctcttttggtttcaaagaattaccgcacctcaataaattctatcaagtattaggcccaccagcataaaccgagtaactttacccactaaggcttaggcaaataaaaagaaatcaccaagtgttagtttgtcatcgctaagatagaatattgtttcaatgtgtgcataagtgtgaggtttaaagacattagttttaaggagctctaagtggacgttcggacataagaattgtaaaattccggaaaaaaataacttttttttcaagtgaaaatggtatttgaaaactagaattgtgtttggacatgaatataattttagtttgttttttgaagttttgtgaatgatctgagtgaaaattttgaaaaacaactttttggatccatcttgaagtgaaatttaaaaatttattgctaaacactaattttggaaaaaaagtaaaaaaaaagtgaaattttttgttatgtcaaaacgggctcttagtttgtcctaagataaattatttagtattcaaatgaatagcccgatgcttatttccagataccgtcattgcttcttctctagaaaaagaattcacgacccgtagactttccaccttcaatcctccatgcagcattgctagtctaggatgaatatacaagatttatatagtcaagctcaattagtttgacactggagagttgattgattgacattgtccgagacaagttatccatctagttcctttatttgttcaatttttatttttccatttcataaacaaacttacactttctgtccagctatgcgcgtggtccggagaacaagagtctattgtagacagccttaccaagcatttctgcaagagactgtttctacggctagaaggtcacatggcagcaactttaccagttacgccaagccaagactccccttctacttactaaaacagaatttagaaacatgatgccattctttcttctcacattctacaaagaaaattcagattatcaagtgtgattatgcacccaatcacttatcaaatcaccacattaacagtggtaagtatatcatcagaagtatagaggaaaatgattaatacatcaattgcattcaaagatcagtaattcaataatactgacttataacattttcatcatccttctttagctaccacaggttgcgcctcctcgttaaaataatcatgcctgaaccaagccaagcgaaaaccaaagctataagaatatctgatataatatcatcggattccctttcatgtacattttcaaagtcttttaatgatcttcatatagtaatgagaaagaaatgactcaccgaatttttcgcgaaagttgatatatgcctgttccagccattgccacatttacactgaagaggttccagtttttctgcaatttagaattatcgatcacagataaagaaaggacgacatcagaaaatcaagaagctaatgaaagaaaaagatgtccaagttaaaggaaaaattgcatcaaagtggctttaacattcttaaaactttattgccgctcttcaaacgactatatgtcctaaatccaaataatactaacatggaatgctattgagttattgcttcctttcactgttcttgagcgatctgtcggaaacaacctctccaccttcataaggttgaggtaaggtctgcatacacattaccctcccagacctcacttgtggatttcactaggtctgttgttgttgttactaacatggaatgctattgaaaagataaatctggcaaaggacgacgccacggaactatgctatagcaaccacttaaataatgtaacttacacttctatgacgtaattagtgatgataccctacaattgtttgcgtgaaagaagtcctactaaactaaagaagcagatgaagcattggtcttggagaagaataagatcacagagcaccagcaaatcgctaaaccatgtgcatgtgatttctcgcctatcatgagtttgactatttatttattctcctttttaaggtaaagccctagagtaaagtgttaggtttggtgataacctatgctgcgcggactctccaaaacagccgccgcacccgtgtcggatcctccaaaaatgcattattttttggaggatccgacacgcacccattgatattttcgaagagtccgagcagcataggtgataactgatttaaacaatgtaagaaattagaacgaatgtgaaaaagatatactttagtctacaaattatgtactaaaaccgttatagaaaagtcggctgaaaaaatagaaaggattatttgtctatcaatcacactctaacatggtaaaaagatacactacttgtgctgagatccagagtaatttgaactcaccggagtaattaccaaactatagcgagaccagataagtcagttgctgtaacagctgcaataacaaaaacagcttatcttaagaataaaaccaaacagaaagacaaaagatctaacaaatggaagatatcatacaatgaaaagtttaagcttgacgagaaagactaactatgaaaattgatatgttttttctggattcatgatagatcaagagacaaagagggaatatcgggagctacaacaacaacaacaacaacgacccagtatagtcccacaaatggggtctggggagggtagtgtgtacgcagaccttacctctgccccgatgggtagtgagaatatcgggagctaatcacagtaaaataacacaaatgattgcgagaaggagaataataaaagacatgagacaaacctatttgctggggtaatgaaatcttttcaggaggtttggcgaaatcagcaatatttgctatgctgatgccccacttgaaggtcggtgcccagaaatgaactagaaaagcacaacgagtgaatgaatcggcaaacaaagaaaattggaaaaaaacaagcataccaacttgaagctgctaaatataaacaagggaaaaacatttaagtctgtacacactttgcagggcaatagagaaagctcaaggaacaaaacatgaacaacttgagccaagcatttaaatgatttccaacctcgagtcatcattcgaaaacatccatacattgtagaggtagaaatttttgaagaaagaactcgtcaaattatgcattcatcaatttcaggacaaactaaacttgtcaagattgggtaatcgatcagacaaactaaacttgacaccaatcagactagccaacaacaacaaccaacccagtctagccaagattgcttaatcgatctccaagtttagtatctcacaatgtaatcaggacatatcttatgtaaaatactagaacatgattcaagagcatgaaactaccaatgattaacactgacgtgcaggagcgaagccacaccattctaagggtggtcaactgaccacccttaggagaaaattaacactgtttatataagttaaatattaagttttaacggtatataaaatatattgaacaccctttgtcggggatttctttttaacctttttcaagtttgaacaccctaggggaataaatttctggcttcgccactgctgacgtgcagcaataaatgcattacgttatccatcaatcaatcaactgcacctcaatctcaaactagttgaggtaaattatgaatcttttacaaaaatttccctcaatccgggctcattttccaatactaaacatataacataagggttctctaaaacttgacattttaaaactgcaatgagctaattttcatgatttccatttcagctgtctattttttcctttcattttcccattttttatatcacaaatttatagttctgctatgtaaaatctaacaacaatacaaaatagaacctaaaaatctaatctttttttttcatttttttttcacctcttcaaataaataaataggcagacagccaaaaataaaaaaaataaaaaaatacaaaataaacgtaagaaaacccagatacaatatgggattttccagaagaatcatcaactcaatcagtttcaagatgcgatgataaatatgcaaatcaaaatggtaaaaaaaaaaaaaaaaaaaaaaaaagaaagatctaaatctaagtatataaaattcaagaatttaaaagaaaaaaaaaacgaattaacagaaaaggaaaaataactcactggtttttgggccagcagggtgattccatagagcctgaagttttgaagtcgccatgaaagggaaaaattctttatctgacttttctctgtataatatctctcgtattagtattactgtagtcttttattggcttttggttattaaaaacaattttcaatttggttttttaataaattcgtagaatataggtttggtagtaacattaaggacactattaaatattaaatggtttatgataatcctaccttttttgttgatttttattttgggtgtgtttggctaaattttttcatgtttccttgacttaaatattttaaaaatatttttattgtgaatttattttttgttaattgtagaaaaatattttatttatcaacaggaataaaaatatttttcaaaactccttctcaacacttcccaacctcaataacccatctcacaccatcacatccacccacccccaccacacccctctgtccaaaaattcctttttttaaatttcagttttttttttatcacctaccttgtgacccgcgcaaaagaaaatattattattatttttcttttgtaatttcaaatttatatatttttttttctgcaccacccacctccaacccgtcaaatcccacctccccactgtccccacccacgcacaaaaaggtttattttttacttcctttttctttttgtaatttttaaatttctgtttttttgtttttctacaccaccccgcccacaccaaccccatacaatttttatttttttgtaatttcaaatttctatcttttcattttttctgtgcccatacccaccctcaaccccaacccctcaacccggagttttattttattttttaatatatatttacacttttagttttcttatgtttcggtctacatgttcgaaattttacaagttccaaagttatgagttcggaggttttgtgtttgaaagtttacgggtttaaaaattataaagtttacgggttagaaatttctcagttccgaaagtttagcggctcgtaagtttatgaaatttgtgagtttggaaagttgttagttctaatgtttatgactttatatttattatatctaaattatttatgaatacttttgaaaagttatttttcttaatttgcatactaaacaccaaaaaataaataagattaatacttgttttccaaaaaaatatttttggcgaaaaacaattttcctaccatacacatcctctgtctaagaaattttatcatgttatattgactcattacatgtaagaaaaatagagtaatattgttagagtaaattaaattatactaatttatattttatttatatatatattatatatatatatatatatacttggatggttgttacctattatattgtaatgtattgtcgctttaaaacgatgtgtgttttgattgttgcttatgttttattgtatcatatcgttaaattcgtcgttacgtaacgacgaaatatgccactttatgtaacgaccgatttggtatggtcgtgtcgttactttgtctttttctctcgatctcacctttcattattattaaataattttattttatcatttacccaaccactttatataccgtatcattattcttttttataatattgcaagtttatttttcatattgctggtatgtaatatcaaaatgataaacgacgcaatttatccaaatattatattcatctaataatacaatacaatacaatataatacaatacattatgaaacgatacgtaacaaccatctatatatgaaacgatacgtaataaccatctaaacaagctgatgtggtagtgaagtaaagtatgagccaaagtatggtagtgttgtttggtggatctatattttatatagcacaaacatatttaattatagtacacctcatagcttatagttaatgaatattcataggtattggtactttattttttctgtgtttatatgatatagtatgctgagcacaacatatgttagtgaatcatggacaataaatattaaattttggacttgttaattttagatgtttaaataattttttttgttttttacagaaaaatagatatctagcatgactaaataaagttttttctactttaattctattctttcatgaaaaaataatttttcgtgtaaattgctctttttgtctaatttacgtgacatcgttaaatttcgagactcaaataagtaattgtttaagcccgactttttcatatgctttttaaatattttaactaattaatcatcgttacttaatattttttatataattttaaatatattttaaaatataaaaattctatgtctgaatttaccattaaactatgtcatatatattgtgtttaattttaaagaataaaataatggttagtgctattaaagcaaaaaagataaaattctccaccaaacttgatgactaaaaagcacaagactaaccaaataatatggaagacaaaagatgaaattcattccattactaaaacccttactagtcattgtaataacctttggtttcaccattttctttgtgctactctctaagccaacaacaacaacaaacccatcttccactaaatccaataccatggcttctagaagttttgttctttggctacatgggttgggtgattctggccctgctaatgaaccaataaagtcattgttcacttctcctcaattcaagaacacaaaatggtcatttccttctgctccttctaatccagttacctgcaactgtaagttataattttttcttgtatttgtagtgttattacaggttgtgggttgttgttgtttcttttggatttggttatggtgtgatcactgtggaattggtgtttttgggtcaaatggtgtattttgattgcataaagattctatttttagcctactccttggtgggatttgttattgtttgtgtattgtttttgtttgtattctgtatgatcgctgtgaaattggcatttttggtcaaatggtgtgtttggattgcataaagatttcagtttttagtctactccttggtggggtttgttattggttgtagtattctgtatgatcactgtgagattggcatttttgggtcaaatggtatattagaattgcagaaagattccatttttaggctactccttgggttgatttgttattggttgtgtattgttttttgtttgcattctgtatgatcactgtgaggttggcatttttgggtcaaatggtatattagaattgcataaagattccatttttagcctactccttgggttgatttgttgtaggttgtgtaatgtttttgtttgtattctgtatgatcactgtgaggttggaatttttgggcaaatggtatattagaattgcataaagattccattttagcctaccccttggtggggttttgtattgtctttgtttctgtggttctatgtgttctgtgaaattggcatttttggatcaaatgttgtattggattgcataaagattccatttttagcttactccttggtggggtttgttattggccgtgtattgtatttgtttatattgttttatgtgttcactgtgaaatttggcattttggggtcaaatgttgtaattggattgcataaagattccattttagcttactccgtggtggggtttgttattggctgtgtgttgtgtttgtttatattggttctgtgtgttcgctatgaaactggcatttttgggtcaaatggtatattggggttgcacaaagattccattttttgcctacattatctggtgtttggatggtgttactggttgtgtattctatttgtttctattggttctatgtgatcacctttgaaatggcatttttgggtcaatttgcatatacttgaattgaataaagatttcatttttgattacaatgtgatggatggggttggtaatcggcatgtcatatttattatttatggtcataattgattgccggaaacaacctctctaacccctctaggataggagtaaggtctgcatacatccgaccctccccagaccccactgtgggattttactgggttgttgttgttgttggtcataattgattaattatgatctctattacacaagagtgtttgatttggtgtagtgttgcaggttctgtattgtaattgtttctattggtgccggtggaattgtcgttctagtgtatatgatgaacttgcataaagatttcattttggccaatgccttggggtttgtagttggcacatcacctgtatcgtctacggtcactattgatatgataatctttataacacgagtctttgttttggtaaaaaatatgaattagttcaggtccaaacagattgaggcacagttgttgttcttattgtgattgcttttaggtctagcggatgggattgcttacaatgtagactaggtccacttgcatcggctgtttaatcaaagttctagatcattttcaaagtgtgaatggatatacatgtctggtccttataagataatttgttgttcgaggagatgagataaattggctagagaagagacatttcaatttaggaatgcagtttctgcttcagtattatgttggtagttgtgattcaaaaaaataaaaccacaacaacaacaaaaaatccagtatgttcccaccaggtggggtctggggagggtaactgtacgcagaccttacccctatctaacaggtagagagactgtttccaatagacccttggctcaggaagggtaataagaagaagtggatagcaagaaaggaagaaataggaagagaaaagaaaaaggagagataaaggataagtagtacgaatactaacaacaagggatacaatacctgaggcgaacaaaaccacataacgtaataaaaatctaagaatatgaagggacatgcgtgctacataaaagaaagaaaaaaattgaatagtaaagtgtaacatagcaaaacatgtagttttggtgttcctctaacaatgtgttaatggagaagctcggggaaaccaaccgaggagtttctaggaaacatatgttagttatttccttttcctttgccttttcattcaattcagtagaaaggggagaatgttggtagtgtagagggctagttagccctgtgggtagggatttaacctttgtagtgtagttcccctttgttagtgaaccatcttaaataaaagctttatcaagttcctttatttttggttgttttgactttttcgttttgatagttaatgcttgccattataggcaaagatgagcagctatagctcttagatgactaagacgaatgataaagacttgcgaaatactgctgggaatagccttctgtataatgacagtaggggtgtacatggaccgagttggttcggtttttatcaaaaccgaaccaaactaactatattggtttggttggttcagttttgtcggattatttcgagttttcggggtttttattaaagaatattattccaatcttactctattaaaagttatagatatagttttgataagtgaatatgtgtttagtaaatattgaaaaaattgacaaacatatgatctattaaaatattctaatgggagaatttttttagtaacacatgatagttattttcttagtcgtgtaacattaatttttcgttaatgtacgctttcaaggttaacacatgataagatcccaaatatttctacattttttaaagaaaattcaatataaagtcttaaaaatatatatataaattaaatatttatatgtcggtttggtttggtttggttttttttactcaatacaaaaccaagtcaaaccaaacctagtcagttttttaattgtttgatttgatttttcgtttggtgcggtttttcggtttggtttgaacacccttaatcacagttattcaacaacaaaggcaaattgataaatataagcaattttctccctaaggatgtgtttgactactaacttagataatattgcatctcattctggacatattggaagataatgaagcaactcaggctgaaacaactcagactagtttcagcctgattagtgcataattacatttcaggatgtgaaaacagcttcttaatgattagattagtttggcggtgatttaggtgcaattggccaacaacgtcatagagcattctccgtgaactttatgatgtatcatattattgtatctaaaaatagtacaaaggaagtttgtaagaagaacactagatttttaacgccatcttgtttgctgaaatactatgatgccagtctcgcttggttttctacctgagctttcatttccatgagagaatatgtagattctccgttaaggacaataatgttcgagcagggttgatacactaacatgtctgtaagatgttgtagtctgttccctactaaagtgacagtatgattgttggttcttcactggaaattgcttttgctagatatttgaccttgtccatttattatcatctcgcaatttaacaaattccaacggaatagtgattgtgtaatttgtaaatactattatggtaacattgccacctttttcactctaatattggtgatacttattacatgtacaatctaatctatttcgtgtcttacttttttgtagatggtgctgttatgtcatcgtggtttgacattcatgaaataccagtgactgctgtaagtttttctctttcacccctttcattcctcgtatctcctttcgctttttcttttctcaaattcccttgtattcgtgccaggctgcattatctgcaaggatgatactgagaaatataggataaaatttagtctaaggcgaactttttccacttaacttataggaaataaggaaatcaacaataacatgtcttatccggtgtatcaaaggcgaaaagcgcaaaaaagctctaaggtatgttggggctttaagcgcaaataaagcttgggttttaacgaagaaaggtgcaaatggagaaaaactacaaatatgtatgtaaagtccaagactaatatctataagcatgaataccaaatatatggacaatgaaattaaagaaaatttacgataaattgaaatatcaactatttagtgtcgcgttttctggattaagctcgtatctagaaaacgtatgccttagagccttgatgacaacactgaagcgcccgttatagcacgaagcgcttaacatgttttgagcctcgcttcttaagcgcctttgataacactggtcttatctgggaccccagtatgtcatcaaatactatgatatgccagtaatagtatccatcaaattcttatgtaatgttgtccgagattggctcagaaacaagacatgttgtacttacggttattgatattgtttccataattattaatgtttaataccatgtaccagagttcgccaaacgatgagagtggtctgctcaaagcggttaagaatgttcatgcatgatcgataaagagatcgatgctggcactaatcctaataatgttttcatatgtggatttagtcaaggaggtctctctctctctctctctcatcctggcaagtttttgtattgctattaaatacactgaactttcaacttatacttgattttgtaggtgcgttaacattagcaagtgttcttctgtacccaaaaactctaggaggaggtgccgtgtttagcggatgggtcccctttaattcttcatgttagaaaacaaactcctgaagctaaaaaggtaattgtctgatactaacttctacttataattttctaaaatttagtttcgaagtcgcatatttattcttgtcctaaaggtggtcgctttcttatgtggagggagtcttaagtgtgcgcaaagggcattggttacgtaagactttcttaatatgatcgctgatctgctaactgtttcactacttgggaggtatatatgacaatatgatacagcgctatagagcgaatttaccacttgttcctcatttctacctagatatataaaccaagtgcctccgccttgtatggaggtgctcgtcaaatagtatttggctatttgtatttgaataatgatgttgatgttgatgattggtcttccggaaacagcctctctactcactcggggtaggggtaagatctgcgtacacactaccttcttcagaccccatttggggttattttacggttatgttgatgattggaagatatgttatctcgagaaccccacccccccccccctccccccccccccccccccccccccccccccttttttaaaattaatcgagaaattctcgagggcctgctggtgcacagttcgaaactcggtgacaattggtttgcccctcgacaattaccagagggttaaactcgtgacacgcacctaacccacacatcacaactgcattcttaccatttgatatgtattcttgattagtttccatgtttttatagcatctaacaccaaaacgctttgagcagacgcctattttgtggtctcatgtatcgctgataggactgtactgtttgaagctggacaagcagggccaccttttctggagcgagctggtatgacttgcgaattcaaggtaattactcatgtttcttgatcgttttgtttatctttcacgaacgtatcgccaataagccattgtctaccatattcgttaggcttaccctggtctcgctcattcgataaacaacgaggagttgaagaacttggaatcgtggatcaagactcgtcttcaaagcaattcttaaagctccacatgatattcgatttgcatttcacacaatcaaagctcttgagttcaaaaactgctgctcatttgctgcttactactgaagttgtagttgagttggttgcaaaacgccttctcattcacgtattaacattttactgtatttcttggctcattttacagttttagttatgaaatatgggacaagtagttgaactgtgaaattgaaagaaagatgttggattatagtttggatcagtattttaaaaggtgttttcggggcgagccctggggcgaggcgcacaaaaacgctataggcgatggtgtggggcgaaagtctcaagaggcgtacgtcaagcaattctgtgcgtacgttcaagcgtttgaggcgcgttttttcagtgaggcataagctcagagactttttcaaattaaaacaaaatttgttgaataagtacttcatataatactcaaattctcaaaatttagcttggtaattattccaaagttttaaaaaggaattgaaatgtattaaatttaaaggcaagacctttttattgattgaaaccctaattcatgatctttcctaattttttatattgtccctagtctgctaatatctcccaaaagaaacgaaatttcaatttttttacaaatacaaagagaactccatcccccttcatagcaacaaaattcaaagttcaagttacaggttagtcatcctttttgttcctcaatgcttgtgcttctaagtagcgtataatagattgttttaactagttttttgtgaggatatatatatatatatatatttcacatatttatagttttgtttaatttttatgcaatttttaccagtttataaatatttattgtaattatattatttttataaaatattaaaattatatggggcgtccccgtgcgtcggggcttatgcttcaccgaggcatatataaaacgcctcgtctcgctttatgcacactcttttaaaacactgatttggatttcggattattacagagtttttccattttaagagcttgaggattataatgagtggtaaatgcaaatattaaacaaaaaaaggagttggtaataaataaattgtaaaggaaatctgtgtcagactatagtttgaaaattgatactataatatagtggtctttagttaccatataatactaattatgatctatgattgtataagaagaaatcgtgagtttgacactgaatatgaaaaattgaaaatcattgtagaagtgatacagataaccactgtaaagggttgatattaaggaattaatcaatacatcacggtgttcggtatccgcattggagtccgagtataacggattcgtgccgcgtagggtcctattccgtgggaagcgttccccatcaagaatttttccatgcttagggctcaaacccgaaaacatttggttaaggaaaggcagcagtctatcagctgcaccgcatcctttgatagtctgtttggatcatctgactgatgagaaagtgaagaggggaaaatagtgcattcttatttgagcaattttcagaaatgactattgtttagtggttattaacttcttatatctatcatgtacataattactttccttagataccttttagttgttatgataatgtgttcgattgtatacgagctactgtattcatgaatacaatagagaaaatcggctaaaaaacagggcaatccagctgtcagccgttgtattcacatgtattcatgaaatagagtaactgcaattaacgttatgataggtctctccaattgtttaatctgctaatttaatgggataactcttatataactcacctaaatcaattataacacgcaatattatcaatccaattaatgagaaggtttatcagacgctaaacacaaaaaaatagagtattcttcagagtttcagtccctctttttttttctgatacaatttgagtttttttcctgacattgtttgaggttctgctcggaattgagacaagtatctacagaaatattttgaaattcgatttttttgtatatgaatacatcatgtatttatgccagatacaacctgtaatagtaacctactgcctgcatgtttcataataaatcaggtgcttgtattctgttgtatctaacagttgcgtccaatgtattcaagtttatttttgtattcacaatattttatttattcctacaacatggtattactgctttattgagtatatttcattggttgtattcattgatttcgtacttgtatgagaatattttactgtatttcactgtattgttgttttaaatacaaatggatacagttaggttgaaaatacagataaatacatacagtttgattgaatgcataactaattgatgaataacatcaaaatgatagaactaacaatgtattttaaaatgttgttgtatcaactcaaatacatataaatacatctaaatacaacaatcaaaaattactatacagaataaaaattagtgtatgcacgtctaaatacaagaagagaaaatcattgtacaaactaaaaatcaatacgtgccttatcgaatacatataaatacatctaaaatacaataagagaaaatcattgtacaaactaaaaattaatgtatgcggactcgaagacatataaatacatctaaaattaggtcattgcgtattattgttctcctttcggcttcaatggttgttgatgaacctgcaaatacatgttcctcttgagtgattttacaagccgaaagatggccctttgaaattatgtgctttagtgggtattctgcagaaagcctaacaatagtgaatattcaaaaaaaaaatgttgaagagaaaagaagaagctttaaccggccaaaaataaaaaaacttaaacacttatcacaactttttggagaaaaaaaaaagttgaaaattgagagagacaatagcttaaaccgcccaaaagccaaaatttttaacacttaccataactttttggagcaaaaaaactaaaaatcgagggaaacaatggcgattcctgagaatcgtggtttaacaatgggaagataatggcgatgtgtgagagaaatcgtagagagagaaataatatattatgcgttaattttggaagagaataactaaaataaagagagaaaattttggacaaaaatttcactttgggttatttttaaagttttgcgagtgatttgagtgaattttggaaaatagctttaagagtttttcaatttttagaaaattttcaaaacacatcttcaaatgaaaattgaaaatttttatgaacaaacgttgatttaaaaaaaaagtatttttgaaaaaaaagaatttttcttaatgtccaaccgggctctaattttcaaatattatttttatttgaaatttatttttacttttctttagaattttacggttcttatgtccaaacgcccacttcatctcttttgggaaagtgaaagaaaaagaggaaaaattctacaaaaagaagagtgatcattagattctgtaataagtggggtccatcaaattagccccactgttaaccaatcaaaattcagaaaaaactatcaaaattttttgaaattgatgccctatactctgtaagatacactgtcccacagatgaaccatcccccaatgtccttttttttctatttttttttattttttaataagtcacataaaattatgtaatcaatttctatgccctttttctcttaccataaactcttcaaagtccccacaaaccctcatttctctttacttcaattcaatcttccttacacccaccaccctattaaactaccccaccctctcaaaactctcccaaaaaaaaagaaatctccattttcttcattaattatgaagaaactttatagaaaaggcacagttcatccaactcctcctttggtttctgaccatctttcttttttaccagttgctattttaactcttgctgctgctttatctcaagatgataaagaagtcttagcttatctcatttcttgttctaccggctccggcaacttttccggcgatgtttccagcaatcggagaaacacccacaggttaaaaacacccaactcagctttgaaacttcaggtattggtgcaaaaagtggtagctccgccgtgagcggcggcgttagcagcggcggaggagctgaacatgtactttccggcgagttttccggcaatcgaagaactacccacaaattgaaaatacccaactcagctactgaaacatcttccagtggtggtgcaaaagtcgctgccgtgagtggcggtgctgaccatccagcttcttttaactgcgactgtttttgctgttacacgagttattgggtgaaatgggatttatcacctaaccgtcaacttattcatgagattcttgatgcttatgaagaaggtttacaaagcaaaaaagaaaacagcaaaaagaaagaagaaataaaaacaaaggctctaatattagtagcggttctgttgaggtaaaaaagacatcatccgagtcaaatttgaacataaacgggtctgttccgagcgggtcaggcgaatccgacccggtggaggaaatttccggcaaccatggcggcggcgatgaagatgaaagtggcggagaagagggaggtgaaaaaggttctgttagaaagtttgtgagttttattggtgaaaagatttggagtgtttggacctgaaaaaatattttttgaaagtaattttcaagaaatatttaggttggttttttgccatttccacttctacttaatctcatattagtttttttttttttttttttaaaaaaatttaattttttttagtggttcctcttttaggttctgtaaaatacccttttacttcacaatgtaaaatatgggtagtgttttgaatgatcaccttcattggttttttcttattttcacaaattttgtataaatcttttgttctctcccttgtggttaaaagttacttatggagtagtttagattaaaaaaataaaaattttgaagttaattccaagaaatatttaggtttattttttgccatcttcatttccactttatagtttttggttcttttttttgagaatatgtagtaaatatttaggtttattttttgccatcttcatttccactttatagtttttggttcttttttttgagaatatgtagtaaatatttaggtttattttttgccatcttcatttccactttatagtttttggttcttttttttaagaatatgtagtaaatatttaggtttattttttgccatcttcatttccactttatagtttttggttctttttttaagaatatgtagtaaatatttaggtttattttttgccatcttcatttccactttatagtttttggttcttttttttgagaatatgtagtaaatatttatttctctattggttaaaaagttgctaatgggagtagcttaactatataaattttatatgtttttttcttggattttattgattgtgaagttgcaagatagtgaaaaaattatggagtagtttagactaaatattctaaagttaattccaagaaatatttaggtttattttttgccatattcatttccactttatagtttttggttcttttttggagaatatgtagtaaatattttatttccctattggttaaaaagttgctaattggagtagtttaactctataaatttatatttttttttcttggattttattgattgtgaagttgcaaaatagtgttgctgaaaataatttctttctttttgttaaaaaggaacatttttgtaattaattaattagttttttaaaagatgttaaattggaattttatttatttaatagccgaaagtggggggctaaggtattttaggtcatatatggacggtttgaagtctgtacttttgaacagtgacaaaaaaaagtaggccattcttgaaatttcttggatatagagaaaggtgtaaacttttttataggccatagaaataaacagtggtctaaaaataattttctgcaactataggtgtcgatttctgaatattcaaaattattacacttttatttttcttacttttgagtactttttttttatttttatatctcatttggctcgaggaaacacaggacgacacttttcaaaattttgtcatatagccaggaatgactcagacatccatgtatggtctttttgtgtgtgcttcttcttttcttataggaaaatgcgaattcagaatttgaaggttacgggtatacttttttattcaataaaaatttatttttgtatgtaaagtgtaactaatatatatataataataattcagtaaaattttatcggtggggtttagaaagggtagagtgtacgcagattttatccttactccagaggggatagagaggttgttttcaggggactctcggctcagagataataggtttgtgataacaaaacccgtaaataataccatcaacgtgagagacaacaaataaatggaaaagcagtaacacaaatattatgcaaaagtgtgaagcacaacattaatcgtcagcattgctagacaaaacactatcatactcgttggtacaaagataaaaatcaggacaaagaggaaaaccgctcgactaccctttaacctacaaccctaatgtttgacctccacaccttcctatcaaaagccatgtcctcgaaaatttggagtcgtgccatgtcctgtctgatcacctcgccccaatacttcttaggttgccctctaccttttctcgtacctgccaaagccaacctctcacgcctcctaaccgtggcatctaggtttctcctctacttggtccgaaccatctaagtcgcgctttccgcatcttgtcgtccaccggagccacgctcaccctctcccggatatcttcattcgtaatcttatctagcctagtgtgcccacacatccatctcaacttcctcatttctgctactttcatcttctggatatgtgaattcttgactggccaacactcagccccatacaacatgggtggtctaaccaccgctctatagaacttacctttgagtttcggtggcacattcttatcacacaggaatccagacgctaacctctatttcatccaccccaccccaatacggtgcgtaacatccccgtcgatctccccatctccctggataattgaccctaagtacttaaaaactttctctcttgaggatgacctgtgagtcaagcctgacttccacgtccgtttccccccgtatgtcactaaacttacattccacatattccgtcttagttctacccaacttgaaatctttacactccatggcttgcctccatacctccagtctcccattaacgccgcctcgcgtttcatcaatcagaactatatatcatacacacacacaaaaaaaatttgtgaaaatgcacgtgctagccagttttcggactggtaactgaaaatagctagagtttgtatagttattgaaaaataaccactattttgctgcaacacaaaaaattctaatataatatagtggagattggtgtatttgtgtatgaactttcagcatattatgctgaatatccaagacacggaaagttccagcataatatactggagattggggcacctgtgtataaactttcagcatattatgctggacccgtattttatattagaactccagtatattatactagaactccattatattatgctagagtatttttcggattttgaacagtgtttttgttaagacttatctttattagttcgattacttttgaaactgtgactatctttcaattaccacttataaatttaactattttttaatttcttcccaaaatttttgttgtactttccgatatctgtaatttctctctttacactcttgaaaaaggtttgaattggttggctcattgtttgaaattgttcaattttatcttttgtatcatatgattatgatgttcaagtcatcttgtatgtatctaaattaattttactgaatatttattatgatgcgacccttcatcgctataagtatagggtaactttgtttattaatttactcctaatttattcaattgcggatattaaaaagcaaattcgatcatttcttctttttatttatatgtttaatagaaatatttaactatgaacttgattataataatgtacattatagtaccaaatactaatgggtttggtgatactaatattaccaactctattgaatttcttgattcaatagtacgtttgatgtgattaaattaaaatattcaataatccaaattggagaactttcaatttcgtgatgtgatataattatctaccacgagtactattatctactactactattttaatcctaaaatttatttaatttagaaatgatccaaatatttaatgtaaagtattttaaaaaattatctactggtaaaatattcaataatcaaattggcattttctagtttaatatttatttagggacacttggaaaaagaaaacccagtgagttaagctaggaggataatatctatccccattttttattttagattaagtttgttttatgcttcttgatgaatgggttgataatcatgggattttagagtaaaggtaaaaatactagataattttttctcatctgtctaaataaagacggaccgatgttattaagagagggttcatcggcactcggaatgttcgacaaaattttcataaatacatgtatatgtttttaaaaaatactgaggtagattttggttgaatacaaaagtgctcatctgactttcatattctggggccaccactgtgtccaactcttggtggataaagttactagatatctataatggtggaaagaagtatcctataaattaattgagttatgcataagctagtccagatatcacgattatgacgaaaagatataaagctaaatataggtgtcacaacaacaacaataacaatatatccggtattatcccacacgtagggtctggggagcatagtgtgcacgtagaccttacccctaccttgtgaggcaagagaggttgtttccaatagaccctcgacttaggaaaacataagcaccacattaatgaaaatataaacaagaagggacaatatcaaaaatcatataaaagcataatagaaataacaagacagtaaggtgatcaacaattaaagaaaataacgattagtcataaaagcctactaacaacagaaagcgaaactgcgtgccaatactgtcgttgctaaatataggtgtcatccccaccaaatctaactatggttgttttccttttattgctcttaaaacttcctcttgttgtagcatttcttgtttaattacacaaaaagggagggtttaatgtccaataacgatcccaacatgtaaggtctggggagcgtagtctgtacgcagaattacccctacctaatgcaggtaaagaggttgtttccaatagaccctcgactcaggaagggcaattagaggagggtttaatgtgcacgttaaatttttgcaattttgcattattaagtttaaggcaccacatttagcatgccttctgtaattttcaataattatttaaattaggcgtaatgacttcctgaccacttaaatttgtatcagttttaaaagctgatatatgaacttacacttttcctatttgaacactccaacttgatgtaatgaatactaataaatacatttgacctttggctatgcctatgtggaagcggcgtagctgacatggctaaattatgtgcaaatcacgctacaaaggcgcgtggatactattgtttttattaaaaaagaaaaaataagaaaaaaaaagacatttccctttcccattttcttttcccctgtcttccctgccaaactccacatctaccaaactccacatcccctttccccctcccccttctattttaattttggagcatagccacttctgtcaaaatatagaacacaacccaaacaattacattacttcctagttatccgtcattaggcgagcttaaaataattacatttgaaactatttgggagatcgaggaattcagatgtcaggtgggcaatagcaacgagtggcaatagtgagggtcatagtgaaaaatccgaaaatcctactattggatgaggcgacaagcgcattggatgcagaatcagagagattagttcaagatgcacttgaccgggtgatggtaaatcgtacagccgtggtggtagcacataaattatcaaccattaaaggagcagatgtaattgttgtagtaaaaaatagagtgatttgtgaaggttcttccaaatttggtgaaattcgattgaacttcatctccaatattggagcttatgtttacagtctccattatcggagcttttgtttacagtccgtccctaggaggtgaagaaaaaaaagaagggaaaggaagaaaaaaatgaaaatttaataaattaattttggaaaaagacagagccctcaattgggaccttgaacatgcacgtgtcacaaaatgtgaatgaatggatgatgtgtcatataaaatattaaattaaatccatgtcaccagcaattgaacaacacgcaccatcacaagtgtttattagtagccattttttcaagtaaagatgttcaaatgagaaactcaagagttcatatatcgactttataaactgatacaagtttaagtggccaggaagtcatttcgtctttaaattatttgctgaatttcaacctcctacccctaccccccaaaaaaaattccctttattatttatttatttatttgagaaagtggtgaagaaggggcagcatagaattaaggaaattgttaaagtaagcttgtattaaagctaaaaaagagatactaagagaattgagtccaaaattgccttttaattattcttcctttttgagtctttagcctaacgaatttgttctttccattatttagcactctgcttcccttttacacaaatatttaaactccaagcaaacttttttctttctaatgcttttctacctttttttggcaaaaagtttttaacataaagaattaggaatttaaaagaaataaatattaattagtcgtgaactttggtttaatggtaaaagcgcaaagtcgatgtttgagttaggcgcactcacgagttcaaaatttctagctgatgaaaaatttagtatttaaatgaagaaaaataaatggatgaatttattatccatcgaattttgaatcgtgaaccagtaattattgaagacttaaaaaacatatattagaagccactaaaatgcttgctattatgtttaacactttccactacaaaattgcaacatagtgtagggaatgtggagtcgagatttcgactttataaattttaaattttaaaactatgacttcaattgctaacaattaagttcttaatttaatatgtatattttgaaaattttcttaatataaatatattgtttaaacaaaacttatttggttcgactgaagcaaaaccattatttctttcaggccgataggggaaccttccgcatgaaagcgaaaggaaacgaccgatcaaaaatacaaagagaaagggaatggttagtgatgacggcataggacacaaaatatttcttctctctctttgaatcctaaggattgcctcatgtgcctagaggacgggccagacgcagcaaagcaatgaccggggaacgagttccccactggaagagggacaggagacggccatctcaaggcacattataacctacaggcaacaccggccatatctgagtttctaccttcgcccgtgattgacgtcattccggagaaaattaacataagagtccaaaaaaaataacatttcgtttttatatgttacaatttccaagtcaaaatccaatttagggtttttaaactttgtcaccaaaatcacttgacaagatcttatcttattgcgttaagccaagaaaaaaaatagataaataaatgttgcaatatccagcatttccactgcatgaagggagggccatgagtccatttataagcacttgggttttgtaatattctaaatttaataatcaattgataaatatcagctctctcttatattatatataattctaaaaaatattagatttagacctattattttaacaatataataaattccgtacaagtttaaactcatttaaattacacgtccgtctctgaatttgtaatttaaattgtaggtccgcctcaggatcagatagtggtgtatatatatagtagtgatcatatgttcatttatatgttaaaaataggtaagttcagttgattaaatttatttttctttcatgtagcagtaggtaataaaagtaaaggttggaacttgacgcacgtaaggatataacaaggaggaattcaaaaatagcagatttacaagtgataattcaaaaatagctacagttttaaaagtaattacaatttagtcactttttatgtaaagataaatctgaatgaagatactgttcaaaatccggaaaaatactccaatatattatactggagttccagtataatatacttaagttccagtataatataccggtccagcataatatactgatgattggagcaccgatgctccaatctccagtatattatactggaactttctacgtgttagagttccagcataatatgttggaagttcatacacaggtgcaccgatctccagtatattatgctggaactttcggtgtttcaataaagtagtgactatttttcaatgattttgcaaatgctggctattttagaatgaccaatccgaaaactggctagtctgtgctatttatacgatataccatatagtgattaacgaattagaattagaattagatttcaaattctaggagaaacaaaaagaaaatgttaaataatttttttcatttatctaagtcttagtgaatagagttattcgttatttgtaatcgtaatttttttgataaaataatataaattaactcagacactactgttatatttaaaaagttgaagcttgactaggtcaaaagcattttagtagggatgaatattcacattggtcgagataaaagtgtaaaaatcaagctcttcaaatttgattacgatttatatctcttgttcaaaatctgcctgacgtatttgacgaggttttttgtttctttttgaaatttcaaatttcaataagtaaactttagttatctcgaaaactgagaccgtctcagcaatttcataaattatcggaatatgtgtaaaaagattaaatatacaatctccgaaattccataaaaactcttggaatattcattaagatatcgaagatttgttaaatatgtcctgcttaaagttttagcaatattcaaaatccaaatggagtgctgctacatgcttcttgatcatcaaatatatccaggaggtgcatatcattctacgttcgaaaaatacgctgctaaggtcctcgaattacggataacaaatcgaagagaagaatcaagggataaacagaattgtacccgcatcatttatcaataaaattatgtttctttcaaaaaaaaaaaactttagttcataagccatgacatatttaaggctgctcttacgatattaataagtcaaaaattagtagacagttttattttccatgtagccaacaaaaaaagcaccacagacaaattatggggaaaaaaatggaaaaggataaataccaacggaaaattctattttgcaaaattgttaagtgaaatgtataagtcaacatgcatcggctcttagggctcgttttatacgacggataagggataattaatttcggaatttaattttagatgagtttattttatgtttagttgggataaaattgtagtataactaatctcgagattaaatttgagatgagtttaccccatatttaattgggataaaattatggtataactaatctcaaaattaattattcggaattatagtattttttttatctctatagaagaataactaatacgaaaataattagtcatggatagtttgtttcctaaccaaatagcccctgagacttataattggaacaacttattccatatttgtccaagtcgtagtctttttatgactaaacaaaatgttattttcaagataagaactaatctgggttggaaaagtacagagatttatatattaactctttattaggtagttaaatacattgatctgtcccctagttaaatttattagccatacttacagggaccattttaattaggctaacttaaacatctcaattattgttttggccaaatacgtaatctaattcaatactaattactaataataagtaatatagagtttaaatgagtagaacttatgaaccaaaccagtgttgcttgaacgatatggacctctagctcgatattctcgatgactcgagtgggtttgggatggtagagcagaacaataaagtgagagctataaagttaaagaacaattatgaagaacagtgagcgagaaaagtaagatagtagattcttttgccatgattagatgatctttacaaatgattggggtcccctttatataggagggaaatcctaaatatggtacatttctatttacagtaaggaattttattggtacagctgtataacaacctagtacggatttgtactaattcgtacaaatctatcccgggatttgcgccgtgattttggggatgtggcgagagtcttgtcctttccgtaacaaactcacaacggcattatttggcatcggtcgtatctggtttcaatgctcatcgagtatccaggccctcgagccttttactgcaccttcgagcccgagctcgacctctctgaacttcttccctcgaggcaatatctcgagcctataaaatcgggcttcttcgattttgatcgtatacaaatagtcccccgtttcttagaatgaaaagataagaaacgatttaattctcgacccttcgatgcccaaccatgatgtcaatctcgtgaggctagtgattggtgtgactgaaagtcgtgaaaaaggttacgtctgcacagttttcgaaaagccattaattgtaaacggctaatggccagtcgtttggcatcctcaacacgcctaagtcacccctataaatactcaactcatcttactttactttccacagcatactcaaacctgttattttctcattctctctgtggttatccctctcttgtgcccattttatcatcaggtttcttttcttctttcgaatttcacaacactaatggcaaaaacttctattacaattccacagaaagaaaggcttcttcgtcttcacgccaatctaaaagcaaaatggtggtacctcttcgtattgaggagtgcactcccgggccttgcgatacatcttccgattttaaaattgacaaacctgcctaggtcccaggtcaatgtgagcctatgtctcggtatatcaacttgatacaaacaactcaaacaggtgaagacagattgccattgggaagataaggtggacgtagagatcccttcacccgaataggatattaccacttacaaagcagggtacctaagtgtgtataccgacccattcaccttaggtccgtagacccttctctacctctcctagatccaatgattcttgatttttgccaacagtaccaagtgacgccttggtcaaatttacccttccttttggcgaattgttcacctgattaggtatttctcaagcaaggtcgagggatgtcttttatcctcgatcatttgattaggctatacaatccccgtctctatcaaggtggcctaataaagttgcaacgtcgatcctcaaagtctttcttctctaacatcgacgaagataaagatcgagggtggatgagcgcttcgttcgaatcaggacctccggcctgattcctgctgaaaagataccgttcccacagaaatggaatatgaaacataagtcagatttatcgagtaagtctcattactttgatgttcccgctttctttttgaattaaccccttttaatgatgcacctgtcgattggtatcctggtacggttgcggaattcccgggctggttcggtaattggcttccttcctcatacgccgagcgcacactggcgtgatttggccaaaggtcgatgggaggctaaaaatcatggtgagtcttcattatctacatatctaagttgcttagtgaaatacttaattttgctttatgcaggcctcagagatgttgtcttaatgaggctgcccccacccgcgaggaagaagccccaaaacctgtcaaggacaagaaaaggaagaaagggtcgctgacgaactcctcgaagccaaagaaaaccaagctctgaaagcctaaggtcgatacagtggccttatctcagaaaactgtcgagcatcttcgtgcttaggacgaagacggatatggagaagagggcgaggataaccgctcgttgataactcgaaaaagaggaagcattgatgattcgaaggccgttgaaccgaaggctaccgatacggttcaatatcgagccgaggagatctctgaggggagctcgagcaaagtcccgagcctgcaagagacaagaatgtgccttgttccgaagggcacttggccgatgaactcgaaaagcccaaccctgaggttcttcgaaggcgggagaatgccctgattgaatcattcgaggaattgatgtggacgaatcatttccaggcccggtgttctctgaggggcaaatacggacgcccaaaatatgaggactcctgatgtggggacatcccatggggagaatgctatcttctggaagtacctcactgaaatcgaagagggcccctaccttgacgcctcgttcatctttgaggaggttgagaagcttcacaagcaagtaaacttgttatgttttgagttttgatttttgtctttctgactcctattttctttttgtgagaaggtcgtggtgctatacaatcaagctttttgtaagtctcgagccgagctttctcgttatgaagttgagttcaggaagtcatagcagatatggatgaccttaaggctctttatgcaaaaagggaggggaaatcagcgagcttccagccgatgctgctgctactaatgcccgggctcaggatatatctactgcagccgagctcaagttgacatgtgccatcaatcacactcggctggaatctcgaaggcaaactctcgaggatgtgcatgctaaaggcttcgacctctctgacgacatcgagaaggtaaagactttggaagaagaggcagccgcattgctctccaccaatgaggatttttccaacggcactgagaataagggagacggagatgaagtcctcgaggaggaggaggcccccgaagataaggctacctaagatgtagctcttgtgaatactgcctccgagcaagtggctccgaaagtagattaggtccttttattttcttcttttgtgtaagggcccctgtgggagtttgtaaatgtactttgaaattatcttttaaatacattgaaccttttcacttcatcttcgtttcatgttaaattttgttttgtctccatttgtgaaacgaaatttggtgttgtagacgatcagtccgattattggacttagaatacaataaaactttgggttttttacttgatcaacgactgataatagattactcttaaggtttgagctaagctttaagtcgatttgactctagctcaaggtgatgggactcttgaatccgagttaagtaaggtctcgagcaccgtgtgcttcggcctttatgctcttatattaaacttagggttttttaatattggccctaagactcttttagattggcccttaggctcttttggtcgggccgattcggcttctacaatggctataatttttcgctctttccggctcaaagacttagtcatactagttggactttcgaaggttcgatcgactggaacctcaattgtaattcgttatgtaacgataattgaatacttcttgaggttttttcgaaggctgatattatcaaagcctctgaattattcgaggctgcttttatcgaagccctttatcgtttgcttttgccgagggtagcctgatttaatcggctttttaaagtgtttgaaggcctttagttttatggtggaagtcggacgtatcgagggggtgcctcttagaggtcttatgagctcgagtatccctctttgaggtcttataggtttgaggtttcaatgattcgatgtgttgattgtcgatggcagtcctcgagtgttgcgttctggcttttgagccatttctcgtagaattataagtgtgaaaatagtagacttatttgagacataaaatgtttcgatatagtaagaaattgatacatgcgtacatgttttgtcgtcggggctcgactactctacatggacacggttcgttttaccgtttggcccattacaacattctcctatcgaggccctctttggcatgaattgttttcttcgaagatgcaaccttcgagggtgattcctcccagtattcgaggttgattgaaaagaagccttgaatacttgttgaatttcccctaggtagcatataagtgttgcctcgttaaaaaccttgtcggtaaaacccatttgggataaaacccgatctaagggaaaaaaaagtgcaacacatgctttaaaacccaaggtcttcgagttgaagggtgcttcgaggtctccaatcgaacacctgtaaggagttagttttaaatataaatgaaaagggagagagggtcataccttagcaataatatcgtttgagtagtgatatgttccaattgtttggtagttgcttgccttccattgtgctaagtttgcaggatcctttcccttcgtttgggtctcgaatattgagggtgacttttcttaggactaagtccccgactccgaaatggcaaaggtttgcccttctgttgtaatacctctcgatcctttgcttttgtgcggccattcgaactagtgcggttttacgtttttcatctagtagctcgagactagtgttcatggcctcgtggttcgagtcctcggtggtgtgctgaaacctgacgctatgttcccagacctcgaccggaatcaacacttcggacccatacaccaaagaaaatggggtttcccccgtgctcgacttcgacgtcgttcgatatgcccatagcacctcggtcaatacttctctccgtttcctcttagcatcatccaacctctttttcaagttttgaattatggttttgtttatggactcggcctggccaattgcgcttgggtggtagggtgttgatagaatctttttgattttatggtcctcgaggaattttgtcactttgcttccgatgaactgcttcccattgtcgcacactatttcggcgggtatcccgaccaacacacgatgtgatccaatatgaagtcaatgatttctttttctcttattttctcgaaggcctgtgcttttacccattttgaaaagtagttagtcataaacaaaaagaatttagctttacttggtgttgttggtaggggccgacgatgtccatccctcatttcatgaatgtccacggggtaggactgaatggagttgttcaccgggctgatggatcatcagtgcgaacctttggcatttatcacaccttcgaacgaactccttagtatctttttccatgctatcccaattataccctggtttgatctccttgtgaaccaaaaagtcagcatcagagtggttcccacaagtgccttcgtggatttctcgtagtacataatcggtgtcccatggtcccaagcagtggtccatcaaaggttcttctatataatgttccattttcattgagtgagaatcgagctgctttggctcgtaaggctctcgactcttttgggtccgagggaagcttcccgtgcttcaagttttcgacgtacttattcctccaattccacatcaaacttgttgaattaatttccgcatggccttctttaaccaccgacctcgacaattggacgacagtccccgggacaatatcatcttcataaaccgacgatcccaaatttgtgagtgcatcagcctcactattctgttctagaggtaaatggtccagtgtccattccttgaagcgatgcaatgtcacttgaagtttttctaagtacctttgtattctatcttctcgaactttgaagcttccgtttacttggtttactaccaaaagggagtcacacttggcctcaatgacctctgctcccaggcccttggctagttcgagacctgcaatcatgacctcatactcggcctcattgttaataattttagaagttttgatagattgtcttatgatattgcccgtaggcggtttcaaaacaatacgagtccagaacctttcacattcaaggctccgtctgtgaagagggtctatacccctgaaaatgtacccgtttttagcaagagttccttttctacttcggtacgatggcaggagtaaaatcagccacgaaatccgccaaaatttgagacttgatatcccttcggggttgatattcgatatcataccctccaagttcgatggcccatttggccaatcaacccgataattcgggcttatgcaagatatttcaaagtgggtatgtagccaatacacatatagggtgagactgaaaatatggttttaatttcctagatgcatttatcaatgcaagatctaacttttctaaatgcgggtacctggtttcagcatctcctagggtccgacttacataataaacaagaaattgcgtaccttgttcttctcgaaccaacacgccacttaccaccacctcggacacggctaaatacaagtagagcttttcatcctacttcagagtctaaagtaagggtgggctcgagagtaccgttttaattcttctaaggcttgttgacactcctgagtccatgcgaagtcgttcttcttcttgagtatggaaaagaaatgatgacactgatcctgataatctcgagataaaccggcctagggcagctatccgtccggttaaccgttgtacgactttcacattgtttatgacggtgattttctcgatggctttgattttgtcggggttgatctcgatccccctgttcgacaccatgaaacctaagaacttgtccgagccaactccaaaagcgcatttctcgggattgtgtttcatgttgtattttcttaagatatcgaacgttgcctgcaaatgagtcaaatggtcctctgtgcgcagggacttaactagcatgtcatcaatataaacttccatagatcttcttatctgatgttcgaacattttattaactaagcgttggtatgtagcccctgcattttttagcccgaagggcattacgttatagcaatatgtaccatactttgtgataagcgaagtcttttcctggtcctctgggttcatttgaatttgattttacccggagtaggcatcgagaaaagtaagaatctcgtggccgactgtagcatcgatcaaacaattgatgttggacaatgggaaagagtctttagggcatgctttgttcaaatctttgtagtctacacacattctaagtttgttgccctttttagggactataattgcattagctagccactcgggatattttacttctcttatggaacctatcttgagaagtttggttatctcgtctttgattaatgcgtgctttacctcggactgaggcctccccttttgtttcaccggtataaatctgggatcgtcacttagtcgatgggttgttatctccggtgggatccctgtcatatctaagtgggaccaagcaaagcaatcaatgtaattgataagtaattgaatgaggtttttcctaagttcgggggttaatccgtcctcaggtataccttccgttctggcagatactcgatcaatatcacctgttcaagtttctcaaccgcggacttcatcgcgtctgactcctcggggacgacgaaagctcgaggagttaggaaatcttcttcttcgtcctcgaccacctgttcctcgatcatctattcctcgggctcaaccgaggatattggctgtgattgctatttggatacttgtttgtccttgatgttcgacttttccgatgtagatggcgtcaataccggtgccaagtcagggactactaacatctccttagctgcatgttgctcccgatatgccgttttcatatcatcttttgttggaacttcatcatttgatgaagggttgatggcattgtcctcatgttgtagatccatggccttccaagcaaagcattataccttatgtcaccttcgatgacatgaaactttgtgtcatatggtttcggccacgtttactaggaggatgatttcccccttcgttgtttcacttgccatgttgaagccattcaagactcgagatgtcgtagatttggtcaagcagcccgagctgctccacgaccctcaatctgattatatttgctgagctacctggatccacgaaaacacgttaaattgaactttatttaaaagaatagaccgagcccgggggtctcccaactggtcatcttcaactcttatcttcgattggtatctgttatgcacgtagtcaatcaagttttgtttcaactgccccgatgctatcgagctccgctcatttagcccctgagtgaaagcttgtacagcccagtcatcggagactggtggcaactccattcgttccaactggaatcgggatacaaattccctcaacatcttgttgtccctttgcttgattttgaatacgtctgacttccttgttgcaacttttatagcaccagcatgtgcctttacaaacgaatctgccaacatggcaaacgaatcgttagagttcgggtgcaggttatggtaccaaatcatggcccctttggacaaagttttcccaagcttctttagtataacagactcgatctcgtcgtcctccaaatcatttccctttataccacaagtatatgtggtgatgtgctcgttgggatcgacagtctcgttgtatttagttatgtccggcatgagaaacttcttcggaataggcttcggggctgcacttggggggaaaggtttttgcataaactttttagagtccagtcctttcaaaaccggaggtgctcccggtatttggtcaaccctcgagttgtacgtttccatttttttatcattgtcctctgtccttttctctcccgactcgaccctctttgtgagttcttcgagcattctcatgattgtggggtcagttcctgatccattgttgctcgacctttccgggactggttcagcatgatgagtagtttttggtcctaccacactcggggtcttctgctggctttgcaactgagcgatggcaatctgttgtgcttgcaatatttcgaaaatcacttggagactgacttccctatctcctcgaccctgtgttgtttgacaactaggttgaacttctccacacatgctttctccgacatccgtgcccaagccgacgtttatagcaatgtgtgaaccaacatcggctgggttaggaactggtgctaccccagggttgagcggtggtacacaggccccttaagctgttgcattttcattttccccgtggaatccgaggccgtcgttaccatgcattgatgtatttgctgagttcgacatattttatcctgaagtcaaagaatctttgacaagaaaaagtgtgaagaataatgtatgttatcagaaaactagcactaaaataatcatttttatctttagccccaaggtgcgcgccaaactatttacctcgaaaatacaagtaacaattaagtctgatttgtagttttagagatacgtgatctagttcaatactaactaataaacaagtaatatagagtttaaatgagtagaacttatgaaccaaaccggtgttgcttggacgatatggacctcgagctcgatattctcgatgacctcgaggtgggttagggatggtagagcaagaacaataaagtgatagctataaagttaaagaacaattatgaagaacagtgagcgagaaaagtaagatagtatattcttttgccaatgattagatgatctttacaaatgattggagtcccctttatataggaggggaaaccctaaatatggtacatttctatttatagtaagaaattttattggtacaactatataacaacctagtacggatttgtactaattcgtacaaatctatcccggaatttgagccatgattttggggatgtggcgagaatcttgtcctttccgtaacaaactcacaacgacattatttggcatcagtcatatctggcttcaatgctcatcgagcatccaggccctcgagccttttactacaccttcgagcccgagctcgacctcctctgaacttttgccctcgaggcattatctcgagcctataaaatcgggcttcttcaattttaaccgtatgtaaattattttttatagccaaatagaaatagccactccttcaaaaatgaaattacatttggagttgaaggattgaagtcatttaattttcaacatcatttcgaatactaattttttaaaatctcttgtaataaaatcttatatcaagaataagaaacagggattataaatcacaaatttaatagttcaatatttttaaaaaggtacggtcaaagaaaatactttttaatttaaaatgataaaatatagttattttccatgagagagaagtgtaaataaggatggaggcaagtcaaggctatggatgaaaacgtctttcaaataccgtaaaatctaagaaaaattcatcaggaaatcttatttaaatttggcctcgacaaattaatttgacatctttggaaaataatttttttgttcagctttatttttttaattattcaatattcggagcccactaacctgcctaattcgaatttatctcgagtagatattaaggggtaaagtattttctattaaattttttttattttaataacttgaattcgaagctaaataattatagggaaactaccagctatgtccatttataagtagcttattataaaaactgatcaattcataaaatattactaatattagccaaatattaccaatattagtcaataagctatttgtagctaaaaaaggtcaaatctttactttcttttaagtgggtgttattagaatcgattgggtacatcttaaggagcgtgaatatcagttttgggatgatttgatggagttttgagatagtttgaattgaaaattcgaagtagaagatgaaaataaaaaataaataataatgtgtagtttccctatagtgggaattttacataaatgtcccaaataagtctcaatttatcaacctctagccattaattataaacttaccaaaagtagtcaagcacatataaaatttgaaaacccaaataaataaagttctttcttcccatgaatcacacacaaatatctcctttcatatttttaagcgtgtttagcaatattatatgcaagacagaaagaaaatttcatggatgaggtagcaaataaggtgatgaaatacaatatatatatatataaaatctaagcagaaaaaagacccttttcaatggggtatggttgaaattcattgataacatatagatgagtcaatatacaatatttgagggcgattgaaggtgatttggactgattttgtatcaagattcgttgttaaaattttatttcaaaaaattcttttgcgacatatgtatcaaacatatatcccccaatatatctcatacagcatgaatacacatgttatgcatattcgatacaaatctgatacatacataatacacaaataatacacagtgtgatacgcatatcggtaatcatgtccttggtgcagaccaagtccaaaataaaacctaagtgtggagaatttacaagtcgagtcaactggctgttcaacaattcttactattgaaataagtcaacataaatgttgaaaaccagtacttctgtagtttttgattttttctaaaaatatttaatacaaaataatttttgggactaattaatatccataacagatgcagaataaaataattccttattttattgctagttgttttttatagccaaacaaaaatagctactccttcaaaaatgaaatgaaatttggagttgaagaattgaagtcatttaattttcaacgtgaattcaaatactttatttgtaaatctcttgcaattaatttatatataaaaaatacgtaaaaggaatcataatccacagattttaaacttaaatattcttataaaggtatagtcaacgaaaatacctttaatttcttaaataataataataataatattattattattattattttctatgatagtgaaatgtaattaagtatggaggctagcaaggcgaggatgacaattgacaacgtatttcaaataccttaaggaatggcctcaacaaattaatttggtatacatattagttgtcacctttgaaaatttgttttattaaggggtaaccataaacgtatcctacgatcagaggcggagccaagatttaaagtttatggattcggtattgtaattcgtttaagttactgtattttaaattgataattcgtatatatggaatagatttcttaagataaatacaagatttggattaaagctattggattcgtctgaacctgtatctcgcatgctagctccgccgccgcctacaatcacaaaaccaataaaataaaattatagaagtcgttaatggatgggagaaattcaaaaatagccagatttacaagtggtcattcaaaaaaggccacactttcaaaagtaatcgtagtttagccacttttcatgtaaagataaatctgaccgaaaatactgtttaaaatccaaaaaatactaatatactggagttccaacataatatgctggaagttcatacacatgtgcaccgaactccagtatattatgctggaccggtttctattacaacaaaataataattatttttcaatgatttgacaaacgctaactattttgaatgactaattcgaaaaccggctacgtcatgctctttaatttgctcttaatggaagtctatggatacaattagtcaatacaaataacaatgacccaatagaatgtgatgtccttggtcatatggtcaacatggtgaatttaccaagaaagtagagtcaactagttgttcaacaattttacaattgtaattataagtcaacaaaaatgttgaaaatgagtacttctatatctttttaatatttttttgtttcaatattacccgatgatagtacatatattaattgatagggatgtacaaatcgaaccggaaaatcgcatcaaatcgaaaagttaaatcaaatcgattaaaaaattcaattatggttggcttgatttggttaggtattgagtaaagatactcaaaccaaaccgacaaatatacataatttttatatataatttaaaggttttatataaaatttcttttaaaaaatgactagaaatatttgggattctcttatgggatgtaatatttaatagaatatgaagtgatccatttttattaactttaaataatatattgtatgattacttttttatcaagtgttattgaaatgaggcaatctctttattcttccatattcatatgtcaagatctattaaattcgtatatcttttttgaattagaagtggtatttcgatatcttaaattaaatagaacataatttaggtatcatattaaattttatatttaaattctgttaaccgtgaaagtttgcatcaaggaaaatttattgtgagacgacaaaaagaataactatttatatgttactaagaaaaatctcccataaaataatttatagatcatatgttattaattttttcaatttttaccatcatgtaacaaaaatccggaaaaaaaccctccacaaaactgaaccaattcaacaatataattgattttggtttgattttgataaaaaccgaacaaactcgatccatatatatccttactaattggtataaaactgatttaatgaagatggagcttattcaacatttggtcggttcacgtttgtgtaccttgatcttggtttaaatttccaaatattaagggtcgtttggttacggggataaatagacaaggatatcccgtgaaattagtactataactaaatgtaatattattgttgttgttggcacactcaaaataaaataagcaaatctcaattatacaatgaaatagtaatattttagtagtaaaagatacgaagaatgatatgctagtaatagcatctctcaaagagtctatctaaccactcaacatcccttaccactaggtcgaaaggtggttttctatccggtattcgatattcgttttggaatttgattaattcaaattcgttacgaaaagttctactttgggagtaaaacgctttctattaaaggcgactttactctcatcgtgatctctgattaatgatttatgagtacctacaactatatattgctcaagttgttatcttatcttatgagcggtggcggaggcaggacttctgttaaagggttcaaaaaggaataagttaaaaaatttaaaaatattgtagttagaaggaatggaaccaatgacttcataatggttttgaatccccttgaacactaagccatgcttatgggttgggtgaaggggattcaaaacataatatataaaggaaaaaattagatttcgccttatatatacagtgtaatttttcggcgaaggaggttcggatgaacacttttgcgcccctaaatccgcccctgcttatgcgtcatggtcttcagcatttatgctgtttgtgtgatcatattaatcttttttttttcaaatttttctctcaatttctaccacaattattttggtcctcaaattgccaaagtttgttagcttttaattggcaatttcagtttgagttgaccatttaagttgatatccataagaaacaatacctcgtttaccttttgaatgggacactcaatctccttaatcatatatgatattgttacggatataatagatatgcccaagatccaatctcatattcgataatttgaaatatttttgtaacgttatttcacttaatatatataatatatatatatatatatatataatatattatattataatatatatatatggcatttgatattcttttatcttattattaattgcttgattattttgataaggtccttgattaaattttgaggcttgtcatcgtgatagagatcatgataatgagagtaaagtttcttataatttaatctaagtttgttcttggtcgtaggattattaatttggacattagtaatccggttatatcaatatttatgtgatcgtttttatgtgataaagattagttgatctcattaactaaattacatagataaatgatgcatatagagatatgatcattgaaccgacttgttggataattcctaatggttagaattgccataaactgtcaatagaatattctcttgaagaatgtgatgtaagaatttcctttgaccttagatcgtcatagtaattgacaagctatttattgtgctttgatactagacacctatggccctgggacgatagttaaaaggatattgggtatgtagaattagtgattgatcaaagatggaatctgtcaactcttggtaattagtttaagctccatattgtcatgaattataaaagaccaaactaagaccttggccagggcaatcgaatgaaagaagaaatgagtttcttaggtcattcaatagtcgattatatttgacatgaacatacagttggtcacctattaggatttgacagttgaaccatatcctagggtgatccagagctataaggacagaaggaattactacattattcttctacgggttcttaagagtaagttgtacacttcatgctatccggtcgttaaggagtgttgctagacgccacccttgattagtatattgatatgattaatttactaacggcttagtattgaacctatggggtcgcacactaacaaatgttctgatctttgctaaaggattaattaacttattatttaacaattgaattaaagaatttaattagttaaataaatatagttattagtccaaatgaaatattattatattctttgagaattggcctaataccacattcagtcaccgcctcaattctcctaaacctaatgagaacaaagtgatgtttgatgatataaatatatcagtacaacataaggcacgagatatagaaaaaaacgtagagcggcatggaataaaaaaaaaatgtcttgacaaaaaaattatttcttggtctttcacgtctgggctacgatttttgagaagaattttagcacaataattttattattttgttcgcgagtttcattgattaaagagttgatagcaatgatcagtctcggtatggatacgcttcagatccgatctttgacatataaataaattttaaacacgaaaatttctgcctaggattattattgtcttccgctgcgtgttacaaatatctatacgcaatcctacagatttatcaccaaccaaatttgatttagaccggaaaatgttcatagttcgggttggttcggacttaatctaaactggaaaaaaaaccaagtaatcctttgctcaagatcagaagaccaaaatcattattctatcttcacataatactacgagtacttttccgtacagtttaggctcctgcgaaaaagagttttagtacaaagtttacaagaaggaaaaactagtcgctcttgaaaataatagcaggtaaaatataattttttttgtattttaatgtcttgtatatatattttttcacataattgacgtatacattttaatatatttgactagcgaatataattatttttggccatttaccaaaaaaaaaagggtgcaacgtgtctgtgcttttctactgtgctgttgacttattttctctgctgggtattcaggtttagtcaatcactttcttttccctaatactttttcttgtttttcttttcaggattctgaacattgtgttgtgtaatcacggacggagctagagcgtcgagagcaagctcggttaaattcgatagctttggtttgaactttgtatttgtcgttaaaagtttattgaatatgtacaaattattaatttagaacccagtaacttaagacgactaaaatcccgaactatatacttgaaatcccgaacaataaaccgccgcaattttataagtttatttaccaaaccaccgctaaatacaataaaactgctgccattttgtaaaattttcctttttttaagaaaatttaatttaccaaaacgcagctatacgcaacaaaaaagtcaaccagatatgcaaaatatttcgcgttcatgcgggatccgatgaaggcagaggtggagcgagaatttgaagtttatggttcgagaatttagtcttcttaagtcactgggttctaaattaataatttatatatatttaatagatttcttaagataaatacatggtttatataaaagctactgggctcggccgaacccgtagccgaaaggctagctccgcctctggggaaggaccgcaatccaagggggtatgatgtaggcagtttaccctgatgcaaaaaaaaaaaacgcagctaaatgcagtatacccaattgagacttaaagcttgtttggatgtttgttacacatcgtttcataatgtatcgtattgtattgtactgtatcgtttgatgaatacaatgtttggatagattgtatgctttgacgttgtttcatgatatcatgcaccagcaatatgaagaataaatttgtaatattaaaaagaaaaattacgatacggggtaaatttattatataaaaggtagaatgaatggtaaaataaaattatttaataatagtgaagggtgagatgagagaaaaagacaagacaatgacgcaaccacaccaaatcggtcgttacataaagtgacacattttgtcttacgtaacgacggatttaacgatacgatacaataaaatttaagtaacaaccaaaacaaacatcgtatttaaagtaacaatacgatacaaataataggtaacgaccatcgaaacaagaagttacttgtatgttctttacctcagttgtgattaagggcccgtttggctataaaaaagatacattttattcgaatattttttcactttttttcgaaatcagtgtttggcaatgaagttttcgattttcacttgaaaatgaatttcgaaaattttcggaaatttaaaaaactccaaaaaactattttttaaaattttcacttcagatcactcacaaaaattcaaaaacagcccaaaattatattcatatccacacacaactctaactttcaaatactattttcactgagaaaaaaatcattttattttttccaaaattttacaattcttatgtctaaacgcccacttagtaaaacttttgggagattattgcaattgaaaaatgcaagatggaacacaggtccaattcaaatctgtgacactccaaaagtataatagagtataatagaaatgttgtataatcctaaatcgtaagaacccgtttggccatagattctgttttatattttggcaaaattctaaatcttaaatcccaattcccaaaatgagcttcatagttggttttaggctaaaatatcactattacatttttaaaattgtctcaaatttttgtattttataaaagagcccaccatttattattttgtaacaatgttgcttcgtctactcgtttatctgataacatatcatgtagttcattataaaatgataattttttaccaaatttatttatgttcaggactatgagttgcgataatataatgaatgttattgataatggtattgttgagtatttgtgatagtttttagaacttgtgggtataagtcatatttcatttttttcaaaataaatttgggaaatatgttttgaaaactgacgtccaaatacattttcatcttcaaaccaacattcacccaaatcaaatttttcaaaataaatttagaaatttatggccaaacgctagctaagtaagtgattttgaccatctgcaaaccaatatcttccaaacttttgatatacatttgaatcgaattatttcctcttgaaagtgaattctcatggcctagttgggacaaggaaaatgttttaattcaatatataatgtatacaaaaaccaagaacaaatcgcatacagtcagatctttgtataacaacattcttatataataatacttcacttaaaaggcaagtgccgaaagcaactttcatgttttgttataatatatgttatctataacagtaatttgttataacatcgaaaaatatccggaacaaacgaggttattatagagaggtttgactatactacaagacatctatacaaacacacttagaatctaagtccagccaacaactagaggggcggagctaggcctttggatacaggttcggttgaaccgagtaacttttgcttaaaatttgtatttgtctttaaaaaatcattgtattatgtataaattgttaatttagaacccattcaattaaaagaattagaatactgaatgcatgagtttcaaattctggttccgcctctgccaacaacaaatccgaaaaactcatatgtaacaccctgaaatcataactcacctgatgatcaacgcccatcagctttgtattacttgacggcttaacaattcttctccctgcaattagttaaaattatggttaggtccatatagacacagctgagaaattttcttaatatgcctaagcttttgacgggtaaagttaggagataatatgtatttggtggaacaatgtgtaaacatcgttaagagtaaaggcagtccggtgcaataaactcccgttatacgcgggatccagagaagagtcggatcactaaggtctatcgtacacagccttaccatacagttttgcgtttattgactactttgaaacttcgatttgagtgctgttatggtttcggttggatggtagtgatgaaaaaggactaggcaatttatggggattgggctgggtaactaggctttgatccggtagaaatgacaccagatagccacttcaaaaggctgttatttaggaattagcccgttcatcataaatttttatttttcagtttaatttttttacgataaaaatattctgaagttaagatttttagtttaaaatttcaggacaaattatgtattagttaatctctaaatagcatccctgaaaatgactatctgtgcactttcctttgatttgtgaggatcttttaattactccatccgtttcaatttagattaaatagtttgatttggcacgtagtttaagaaaaaagaagaagactattgaaacttgtggtcttaaaagcttaagagtaaaaactttgtggaaccatgacatttgtgtggttataaaagcttctcattaagggtaaaatgtacgtttaaagttaaattattttcagatttaaaaatgttgcatttattttgaaacagattaaaaagaaaaataactcatctaatttgaaacggaggaagtaataaaaatgcaactaaaaccaaaatacaaaaataaataaaataagatataatattttaaattaataattatacatattcaataaattctttaaaataaatatataatttggaccagagccactgaattcgatcaaattcgtaactcctgctctccctttaattgaaacttcaaaaacaaaatgttaaatgttttaaaaaggacatatatgataatgtgacattctctaatttgtgtaaaaacaaatcacttgcggttatttgtcagtcaatcgaagtacttcattatagtttagtacgttaaggggtcgtttggtagggtgtataagaatagtacggaataaaatgcattagtaatgtatggattaataatgtatgagttagtaatacaagcattagttatgcagatattattttttatctactgtttggtatggtgtattaaaattataatgcattgcataattttttttagaaaaatagttatttacaaaaatgccctccatatgctctagctttaagggactttaaggacaattttgtctttaaccaagctaatgcatgcattaatagccttggtattactaatgccatggttttctatgtattacttatgcataggataatgccaggtttgatgtataactaatacgagttgaattaattatacacaggttgaaaaaaatatcaaacaaggtattagtaatgcatagagctaatacttgcattatcatttctaatacctcctaccaaacgacccctaatagtttaacaacaggtcgctctaccagcgacctacctgcttaataataaaatttatttttcaagaaaaatgagtgaataatttgtttattcaaacttcatttgtataaaattatgatttaataaagatggagtctatgcacaattaagtttcatacaaaaagggtaatgagagaaacctaatatatctcatttccaactaattatcattatcatttgaaagactaacaaagttttgggaaaaaaactcacacaaataagataacccaatcttaaatatacataaaaacggtagcccagtgcaccaagctcgtgctatgcacggggtttgggaagggccggaccctcagtgatttgaaagggttaaatatcaacgcgatcatgagatgtcatggaagtgacctggcttttatttgcctcactatcagtgacctccacctctagggcgacctctagctgtctgggcggtggtgaagtgactggggctgaagtcgagaccacaagggtctgttgtatagggtctgttgtatgcactcttaccctgcatttctggaagaggttgtttccacggctcaaacccgtgacgtcctgataacatggcagcaactttacctgtaacgcccaaggctccttccaatcttaatatacatgatacaataaaataatttatgaattttagcagaccattcacaatacactgttagatatcatataacaaggattacatcagatgtaataagtataccatatatacaagttgtagtttactaacctattggagaaaccaaaatctgatcaataatacagtgacaatgtttattgttggttataaaaagagtcagatcagacatgtacaggtatagatgaattcattgatacacagcctttcaatcgttcaagaatggcgtttcgactcacaagtcttgaatggagtgtcaatggaagcccttctttgacacattcgtcgtatttctctaatgcagatacaatgtctgtgaagtctggcctctttgaagggttcgctgcccagcagcgttttatgagatgcgcgagtgctggttgacaactcgcgggcaaaggtggtcgttcattctgcaaaatagtgaaagaaagatattaaaacagatgaaattccttcaagttttatggaggtatcaagaaggttgcatcagaatagaaatgaaaatggttcaatgaatctcaggcttctaacacatttgaccaggcgatcaaacagaattacagtcgctagccaaatatacaatagatatacattggctatgtataaattaatatacgatatacatattaagggtggtcgttcgttctgcaaaatagggaaaagaatgatataaaacagatgaaatttcctcaaattttatagaggtatcaagaagattgcatcagaatagaaatgaaaatggttcaataagtctcgggcttttaacacatttgtccagggctccaagcggtcaaaaataattacagcaactagccaaatatacaaaagatataccctgaatatgtataaagtaatatttatattgtacttaatatacaaaagatatacatttccgcgctggctattgttttgggaggtgagtataaatgtgtaaagccaagtgtaatgtgttgtaatagtacgtacttctaggctccttcccggctactggatcactccagtgcttcaggtactatggactatctgtcatccattgtaacagagccatttcattagcgagggtgcctaagcgcaattctttgctttcgcttctgatgagaatcaagtgcagtcagacttctctataacatttatatataacaatcattcattataaaagccatgtttttctcggaccggtttttatattatgttataatatatgtcctctataacaacacttcactatagcaaccaaaaaatatcggaacaaacaaggttgttacagagagatttgacgtattagataaaggtacacgacgatattagtactatgacctcctccttttggttgagaacagatctttctccataacattttgaagatgaattattcttgttaataagttcctcaaattttcaatgaataacaacaacaataacaaatccaatagtttcacacaagtggggtctgagaagggtaagatgtacgcagccttacccctacccctggaagggcagagaggctatttctgattgaccctcggctagaaaacagctgaaaaagaaaaggtaattgcaacaagataaataagatcgaatccaagaatacagttaaactctacatagtaatagcaatctatgaataaaaagatatcatgctaatactaatgctaacgaactgaataagacaaagagaaacgctgactgcctaaagtaaaacaaaaatatatgcagaagtctaaccttctcagcaacagcaaatgcagcttgcacgggcgtcattccttgaaatggcaacagagctgttgttagctcccaaagcacaattccaaagctatacacatcaactttgcgcgtataaggtttttccttaatcatctctggtgccatccaacgatacgttccctatttcctttagcttctcgacactgtgtttcaagacatgatgtcccaaaatcagcaaccttgacacgcatttcgtcgttcagaagtaaattacttgatttaaggtctctatggataactccctgtgaatgcagatacgccatccctcgcgatatatcgagagctaacctcagaattgtttgattgaaagtgaataaggctctttcttgtttagatacattctcaatgttccttgtgacatgtattccataataatgcagtatacaggaggctttttacaagcagcaatgactgttagataaaagatgatattttgtaagcaaaactgtgtcattaggcaaacatttgacaatagattatagaagttgcacaagtttatggaatccaaattgacagtctaattcacagatataaaaattagaaacaagaaaagctataaacttgaaagatcccacacaacctatgttgctctgactctagaaaaatgccgccaggtgcgtgtcgaatcctccaaaagtagtgcattttggaggatctgatacgggtgcggctggagagtctacacagtgtagcacacagcaaaaccgctcaatgaatagtatctttgtttatactgcccatttaggaagcctaaataatcaagctcatgccttttgttttttagtaagtaacagtcaagctcattctcaacataaatatgaattgcactcagaggcgaagctatgtatggccgagggtggttaactgaatatccttcgccaaaaaaatatgctatgtataaggtaaaatattactacttgttattgaattttctggcttcgccactgattagcgtgggcaaactacacagatcttgtttttattttctcaagaaatgcaaagagcaaccgcctatttcttttttgctttttcgatgttgctgatggtcgaggacagcatgttgagttttgacagctgaacattaaaagatggaagatgcatttgaaaatcagaatcttcctagagacagaacacggggaacttcatccgcgcagaacaactaaagctgtagctaagccagagttatgacgaaattaagtacaatcaaacctctcaataacaacctcgtttgatctgaatatttttggatgttataacgaggtgttgttatagagaacataacatgaaaattagttccggaaaaagattggcttttatattaaagtgttgctatatatgaatggtattatagtaaggtccgaccgtatttagaacaaggagaaactatacatgaagaagtaaatacttagaaacaagacaaatactagacatcaatgtttgtgtgctaagaaaaaaccttgtgttacaaacaggtaatgtcacaattctctagtcaccctgtgtggcatatttggttagttgattctttttgaaatacagtaataaactgaccacttagcttctgcaacagcataataattcacttctcagagaaaatttctactgttccaactacaagaatacaactaaacatgagacaaaaatcggatttcattccatctgcctaagtcttggcggatagaattatgtagcacatgtgctagtgagagataaaagtaccaaataaacatgatacaacaacagggtaatatatacgtacgcagaccttatccctacctttaagaaggcaaagaaaatacaatactaacactaagtaatgcaccaaaactaggcaatccggtgcactatgctcatgctatgcgcggggttgggggaagggtcggaccacaagggcctattgtacgcaaccttaccctgcatttctgcaagaggctgttaccacggcttgaactcgtgacctcctggtcacatggcagcaactttaccagctacgccaaggctccctttcggacagataaacacgataaataacataaaagagcataagtatgattacaagtaaacatgataaataacataaaaagagcataagaatcaaacaacaacgacgacaacgacccagtaaaatcccattaatggggtctgaagagggtagtgcgtacgcagaccttacccctacttcgaggagtagagaggctgttttcgaaaaaccctcggctcaaaaagacgaaaaaagacaatatgcaataccaccaatagataccataagaaaatattcgagagatataatcgagagagcaacctgaactatattgggatgatataatcgagagagcaaacgaacttcagacttaaactgctgttcaagtttagctcttgtttcctccttatgagttggaatcctaaccattttaacagcaactgctctctgcttataaattcctctataaatcctgctatgtgcccctgaagcaaacttattacctataaatagctgagacaattcagctgtccattcttcttgatcctctttagaaacttcccatgtttcaacattatcagattctaatatcattgaccatgattctaaactatcaaatcttttcttgtccattgtttctatatcagatgaattccattgatttcttgatgaagatgaaggcatttctattggtttactctttgacctcctaagcctaaaggggttaaaacaagtagccatttgggaaaaataaaattgacaaaacccctttaaacaacaacccaacgggatctcacaagtggggtttggagaggtaatgtgtacgcagaccttacatctagcctggagggcaaagagattgtttccgaatgatcttcggctcgagaggaagcatagaaacgagtaaataacaacaagaaggccaagaaaacgataccaacaatgtaagaactggagaaaaacaaatggaagaaagcagtaacgatagtaacaagcagtaacacaacagggtactagaaaaccctaatattggcactctaagaatcgaagacaaaaagtatcaaaacacactttcagaaggtgttttttcttctgaatgtgtgatttgatttcaagaaatgcatgaactgatttagaaacatgggttccaaagggtaaacttaaattcattaatctatcattaaaaacaaatcattaagccattacacctataaagtttttcaaccgtgctcgaagatcaagaatcagtctttcattgttaaatagactggaagtctttagctagtgcgctgacaacgtttttttgccttaacctaaataaagacagaaggttttaggaaagttgacgttaaaaaacaagaaaggaataagctttgcatgattaaggaaagagaaatttcaagaacattgaagagtaaaaattacaagaaagagctatggaaaaggaaaaaatgatgaagatgaggtagaaaagatttcatggttataaaaattgaaagaagaatagccataaaaatggagtccttttttttgcagaagtagcctgtgaaagttgcatgaaacttttggaatagtcatgttgagaagaaaaaagaagttagtttggtttgggaaaaaaaaaaagatgaatgtcaaagcaataatttcaaaggagtcccgtgaattcttggttcaagatcaaaagctttttaagacttgacatagaaaaagtaaaagaaaaaggaaaaggaaatgaaaatgctttttttagaaggaatccaagtcttcttccttcttcttttcaatccatcaatggtaaattgcttttaagtggccatattgttacaaccacaaattttagagaaattaatttaagcacatttataaaagaacgggtgcggggttcgatcccactcaatgctcttttggtctgagcctgtcatatgagacttgtctagtgcggtttatattccctgtgtagattgcagactattacacagtggaggatttatctaatgcgcacagagtactcacccgaataacaaaagctgtggcagaaacttctatattagaacaatattcagacgatttcttcggcttcatcttattcaattcataaacacgttgatctgattaatttggatttgcgtcccactatgcctactaaacgagaaagagctcgatcgaaaattttctctatttcatgttgtaatttttaaactatgtttagcttgcatccaaaatacatcactttcattttgtcatattaaattatgtttcttttttctagcaaaaggcaaaaatagttagataatatcctctcatctatctaattctagtgaatagagttatttaatatttacgctggtgaaaggaacagatactcataaaataatcgaagtacttgctcaaggccagtttaaaaggctaattgtaacattaacagttgtaccccgaggcggatgtagtgtattacctacgggttcaactgaactcataactttcgatgcagagtaaaaattgtttgtaaaaaatcattaaaattgtaaaaaagtagatatcaacccataactttaaaaatataatgggttcaatgttaaaaaccttaaaattgaacctattagattaatcccggatcttcctctacttctaccatactaaaatataggacatcttttgccaaaaacaaacaagttatagttgttttaccaaaaacaagataaacacttttatgagcgaaatggaaggttaatcctagttaaactcaataactgtcagatctgtgaatgtggtgataaacgaaagaaataaaggcgtcgtaatattaaatatcggacaaagatactgacaatgatcgacaatgaatgtatgagttggtggaataaatgcatgcaatggcaagaaacgtaataatagaagatgatgtgcctgaaaatcaagcagtgatagctagcaacctcgttgtcaacgaaacagatgacgagatacgtggatcaggcacaatgttcttggatcttgtttatgaaaaggtttcttttaactttggaatcaatagaaaagacaagaagtgtatattctttcaatagtcaatattacaaagtgttctttctcagaattttcagatgcctttttcctcacccatttttcttatatataggggacattctttaaggaaccctaaaaaagtacaagggagagaatattccattagaatattccttcattctaatttaaagttatattaccattacaatgggtctatgatttcgacctcgttcgaattagaaccttcgaaccttagtgtaggccgacctatgctctgaccttggttgtcatcactattaagatcgatccaaatttcgaccaatacagttagtccctccgctcatcgaggtcgtgggtccctcgtccttggtgagcttgcgtccgttatggaggaaatttggtcgtaaccgggtaattaacgtccgtttaggtcgcgactaacacaagtgatgtcaaatgatgtcatcatcacacgcgtcatcattatgcatctttcccatgcaatacctacattgttggtgcttcgattcctgtgcttgcaagcagcttttggcctcgattttgaggccacaatcctataaataggcgaaggactcttcatttgaaactttcaccgtctctctctcctctgatacctttcatcacttgtgcctctcttcttccctttctgcaaatcttcctcttgatttcttcatcccctttcttgatccttatttcttttgctttcattgtttgatttattacaatcatcatgtcggcttttccttgcagtcatgatgatattttcgacgccgctcccttgtcagtagctatccttactactgatgaaggaattttgattgagggagcgagagctttccctaagggacctaggcctaccccgaacctgaactttccaaaatgggggaggccggactggcggagatacgaactaagtatcgcatcccctccatatagaattcatccttgcgggaagtgacacggtccaggttcaccatctcgggcgttgtgtcttctacgtctatccgcttacgatcggctacaccttcccacttctcaagttggccgaagagttttgtcgcttttacaatatttgtctagcacagctctctccttactgttataagatcttcctaatgctgactaaatatgcagagctggccggctgtggagtcgaccttcgccatttgctacacctattttcgcccaccttcttccggggcagcatgatacacttgaggaatcgtgggacgaaagcattagtggccgggatggatgacaaggcgagtcggttattctggcgcaaatacttcttcttcagaactgatcagttggcagcggacctgactggatttcctgaaaaatggaattaccactgtaagtacttccttgtgctttccgtcatttcgttctttgtcgttttctgtcctttttggtttcttcactgcttcctcgtttacaactgtgaagtgttctccttccattgttctagacatggaggattggttgactcgtgtactgcctcatgtcatggggattcgtgattggtcttctttctacaaacactatggttcgaagatcactcctcgtaagtatcttggttatcttgtttggtcgagtgcctcaacattttctgacacttcttatttgtattaggtcgggcggcttccaagaaagcgaagatacctgctctcgccttccgtcaaaaggctgcctcagctatgatagagttcaccttggtcgaatccacgaaaggcaaagctgggattcaacgggtggagggggccgccccttccgatgtgggttgtcccaggtgatgtcccgtctcagcaagtccttcttcttactgatgaaccttctcgtgatgaggagccatcgctgaggaagagcgaagggtggagaggggaaaagtcgtggccgtcgaaggatcagagagggcttcgatccttgggacgaggctggagatctttcctgccgagaagacggacattatgcctgagtatgccatggaagagaggccttccaaggccgaggagatcgatggcggcatggaggctgcacagactacaagtggtcatccttcatcaagtacgagacgaagtgataattttggcgtgggggatgtcgattcgggttccgacatcgaacccgacgaggttagagccttcattgaaaggacgactcgcatggagataaggacggagggtcctaatcgtccacatagtcatacctgtggatttcaaccttctgtcgataccgagcgcgtggcaccatcgtttgcccctttgtgtgctgaggccgagaataagactctacagacattgaaggatgccgacttttctctcggcatatctgggatggctctgcgagtgaatgtctttcttatgctttcatacgctccgtagtgttgcttcattttgactgacattctttttccctttttgtcaaactctgatcctcgatattgagtgtgatcagggagatgaggagaaggtggctcagtataagaggatggagtccaagtacagggaataccgttccaagtatcagaaggtggtcaggagcatcgacgaacgggttgttcagggaaatgcatgacgcgattagggggaaggacgaggagctgaaagagaaggatagggagctactgaaagccattagccggagtagcgagctagaagaggcgttgaagttcaaggaggacgaacttgaactgggtaagggagtgctggctatgaatttggacctccaagcgcgagcggtatccttgaggatcgagcttgatcagagtgaggcgagggctaccgctttgaggtccgagttagatgccaaggatgaggagctgaagctggcgaagcgattttgaacagcctcaatagtagaagcggcagccttggcagggaccctgcgcgtctataggtccgagcgggctaatgaaatggagactccaacgctcacagtggcgagattggaggagcgggttgggggtctggatgcggaactggcgatgttgaatgagcagatagtggttctgagggctgagaaggaacagatggcccgtccgtctactcaaaattccgttaattcgagcgtgtcgcagagagtcgtatgagatgtgggttcatgtcgaggctcagctggacttttcagggcattgagggccactgggaagatctccgaggaagaacttgtcgatgttcatgctaaagcgcgggcagcccgtgaagcttgtggctatgcccctgattcgcctggtggggacgatggtgatgatgacacagtggatgggcttgcttctgatccctggtatgatgacgaataatgctgaaggggatgacgcggtttagtgccttgtgtttgactgttgacgctcttttttgttttgtttttgcgagggtgtactcgggcccgttgtaaaagaaacgagttttgtaaccagatcagcttgtaatggaatggttaccttttgttgtatgcttttccttcttgtttcttgccttatttcgtcgtgatgttattcttagtaggccgatcgtcggctatcttggggccaatctttggtcggtcgtcgaatgtaaatacttagagtgaggttgaatgtaaatgattcgagcgaggacgaatgtaaataattcgagcgaggtcgaatgtaaacaattcgagcgagatcgaacgtaaatgattcgagcggtgtcgattgtaaacaattcgagcgagatcgaacgtaaatgattcgagcggtgtcgaatgtaaacaattcgagcgaggtcgaatgtaaatgattcgagcgatgtcgaatataagcaattcgagcgaggtcgaatgtaaatgattcgagcgatgtcgaatgtatgtggagtggagcgatttggagttgtgtgaagaacttttgtgtattgctttatttattcacttcattggagactgttacatactttgtttactctatacatttgagaagttctcatctatctagtcccttcatcgttccggctggagtaaacgataggtgaagcgatgaataaccagctcgaacttcaaggcgccccctcatcgcctcattaaaaagctcctcggtaaaacccatcttgggaaaaaacccgagtgagggaaaaagagtacgacttagagggcgtctgttttcagaagttgaagtatttgagatgagcgatgttctagttgttgggcaaacagtttcccctccattgtttctaactggaatgatcctttattaactgctgtggtgatcttgtacggtccataccagttggttcctagcttacgctctcttgggtttttgcttgcctgtatttcagccttgagtacgtagtccccgaccttgagtggtcgaattttgcctttttgttatagtattgttctgctctttgtttttgggcgaccatccttatgtatgcaatatctcgttgttcctctatctcgttgagatcttgctttctgcttttatcgttgtttggtccgctttcattggagtatctggcttggctctccgactttgactggtatgactgcgtctgtgtcgtagactaaagagtatggagtttttcctgtgcttgtctttagcatagtgcggtatgcccataacacttctggtagcagttctggctacagtcccttggcgtcctcgagtttctttttcatgatgtttaatatagttttgttggaggattcggcctgaccgtttccagcgggatgacatggcgtgcagagtatgcgcttgatgtgccatttctcgaagaacacgacggtctttttcccggtgaactgtggtcaattgggatgccgaagcgacatattatatttctccatatgaatgtgatgacctcctattcgcgtatttgggtgaagtcacctgcttctacccatttagagaagtagacagtcaaaactaaaaggaaatgtacattacctcgcccagctaggagcggccctacgatgtccattccccatttgatgaatggccagggtgacatgactgaatggatgtatttggcttcttgatgtatcatgatggcatacttctgacattgttcgcattttttgatgaagtctgtggcttgttttttcatggtgggccaataatagccgacccatatgaggcatatgacgagtgctcgattaccggtgtgggcaccgcaacggccttcgtgtacttcttcgagtactcacctggtttggtttggtctcaggaattttgccaaagggccgccgaacgtccttttgtacaggtcattgttgatgatgttgtacctactgcctacattcagagctttcttgcttctttttggtctgctgagagtgttccctcctgcaagtaagttataatacggttgcgccagtcctaggttaagttcacagagtgtacctcaagtccgtctaatgtcgagcagagtaatgtgacgacattgtcctttccctaatgttttttgttgttgctgctaacttggcaagaccgtctgcttcggtgttttgagctcgtggtatttggtcgagccagcattcatcgaattctggcagtagtttgtggatttctgtttggtatttttgtagcctttggtcctttatttgataagtccctgttacttggttgaccacaagttatgaatcgcaccagaggataactcgccaggctccatatttgagggctagttttagttctgcaataacggcctcgtactcggcctcgttgttagtcatatctgggcatcgtatagattggcggattacctcgcccgttgggacctcaagtacgagtccagtcccgatcctgactcgttagaggcgccgtcggtgtgtaggacccataggttaggttggagagaagcgttcagaagggcttcctgttcggcttcaggcattatcttggcgctgaagtcggtgacaaagtcggctaacacttgcgactttatcgatgttcgcggcagatatgtgatatcgtgcttgcttagttcgatggcccacttggccaatcttcccgatagctcgggtttatgtaagatacttctaaggggaaaagtcatgacgaccgatatagggtggcagtatggcactgaaagtaaggtttgagctttcgtgaagccgtgaccagtgctagggccagcttctcaaggtgtgggtacctcgtttcggcatcgaccagagttttggtaatataatagattggtattgcgtacatttattttcacggacgagtactgcacttaccgctacttttgatactgccaaatatactaggaggtgtttgccggttttggctttggcgagcagaggaggcgaggacagatatgacttcacttttctcagggcttcgatacattctgagttccactggagtccgttgtcctttttgaggacgttgaagaatttgtggcatctgttagaagattgtgtgatgaatcttgacagtgcggctatgcggtcggtcagcttttgcacctgtttcttgctggttaatagttcgggcattctttcgatagctttgatctggttgtggttgacttcgatgcatctttgtgacactaagaagccgaggaactttcctgatgtcacgccaaaggcgcatttctcgggattcagctttatgttgtactgtctcaatacgtcaaaggcctctttcagatggtcaacatgatcttctttccttgcagatttgactagcatatcgtctatgtatacttccatcgtttttccgagttgttctttgaacatcttggtgaccagtctttggtaagttgctcctacgttcttcaatccgaacagcatgactcgataacaataagtcccttggtgagttatgaaagtcattttttcctggtcctcctcttccatgaggatctgattatatcctgaatatatgtccaagaagcttaacaactcgtgtcttgccgttgcatcgataagctggtcgatgtgtggcagcgggaaggagtcctttgggcatgctttgtttaggtctgtgaagtcgacgcacatgcgccatttctcatttttcttcttcaccatgactacgttggcgacccactgggggtacttgggattccctaatggagccattggctaatagtttctctacttccttgctgactgcttcgttgatagcggcattgaatttccttctcatttgccgtattggtggataaagcgggtctatattcaatctgtgtgtggcaatgtcctttgagataatctgcatgggagaaagcgaataagtctgcattgttagttaaaaattcatgaaatttacatggtttggagagtttgtggccgatgtaggcctttttgctggcgtcgtttttatctagttggacggggtcgaggtcttctactattgaacttgcggcttccacggagtcgggttccttgatgacatcattctgaccgttgagttttgttcccaactttggtaattgctatgcttccgagtttgttcctttcagttgttgagtgtgtgtacaatcctgggcgatgcggtaacactcttgtgatgtccattgctcacccctgatgctagatattccccaagggttcgggaacttgattacttgataaaggccagacggaatgacccccatactgtgtatccaaagtcgtcctatgatggcgttgtaagttgtgtcctggttcatgacatggaatgttgtctccaacgtgacgcctccaaccaggacgagtagcgttatttctcctgaagttcgttcaactgcattgttaaaccccgttagtgttatgcagcgtggtactatcttatcctcaagtctcatttgggcgagaactcgggggtggataatacacacgctgcttccatcgtcgaccattattcttcttatgtcagtgtctaaaattcgtaatgtaataacaagagcatcaagatgagggaaagtcaaaccgtgggtatccgacttattggagaagatactgtcttcgaggtcgtcataccgttcgtgtgtgattgatcgctttagcttgtgcgtggtggtgaatttcacatgattgattgtggcctcgtcgcctccgccgatgatcatttggatggtgcgggtgggggagggcggatttggggggccctggtgttattctcgtcctctgccgaaattggctcttccgcggtcactcatcaattcttttaggtgtccctggttgagcatgttcaccacttcttgtcacaaagctatgcagtcttctgtcttgtggcctcgttcttggtggaattcacagagggcattcgaccttctggtgtttggatcagacttcatcttttgcggccatttcacctttgggccgaacttttctagtgcgtaggggagacacaaaaattgtgagtagataaaagcgggggcatacctttgttgttccgttgagcccctgtgtttggcctagaagtcccttccatatggcgaggagatggtggaattgttgttctgatatatgattggtgcctatcacggttgtggcgtaggactaggtgatcccttcgagtgtcattacggcgatatcgtctggactctgtatcgattgacgttagccgttgagtttggccattgaggtcatcctcatctgctcggacttcggcgcagtaggtgttgtgaatttcttcccatgtagtaggagggtacttcatgagcatgctcaacaattttctggtcgccctcgacccaattctattcaacccgttctggaaggcgacacggccatgccttcagatacatttgggaagctcatcctgaccctattgaattgggcgaggtagtccctgagtccctctccaggtgaccgtctaatggtgaatatgtcgctcaccctggccacgacctttttagctcctacgtgggtggttacaaacttattgaccatttcctcaaatgttgttatggaccgtgctggcagttgtgagtaccatgtcagggttcccccgttagaatatcgccgaatttctttaatagcacagatggtacttattcctttgagaggtcgttgcctttcactgccgtgacgtaatagattatgtagtcttctggatctatcatgccgtcatatattttcaaataagacggcattttgaaggttttggggatgggatgcggggccgcttcttcgctgtaaggttgctctacgaaccgaccaacgtctcgtttaggtaggagttttggggcgccaggtatctggtcgaccctcttttgatgctccttcatctgatctcgtagtgccttattttcattctccatttactccattttcctcaatatggttgtgagtgtgtcgttacctacatcaactgtagcgttagtgttacctgttgggagggaacggtttgctcgtcggcggtagttgtttctgccggtatggcattctgagccactccttggataggcttatcgaggaagtcatttagtgtatttgtcagccatgcttctagtaaccttttcaccgctggtagagcttcctcagctgtagatgtggaagcacctctttctcgaacaactgttacactttcgctgggagggggtgagccaccatgcccggttgtgatgcggggcgtggtgttcagctaccctccgtcattatcctcattgatggtgttcatgaggttggcagtaatgtttacaatggctttcaacctttcttctcctcttcctgccattgttagtttatgcagatggaaagagatgaatgtgtgcgtgtatgtgctgttgcttgctcttttttttagatctaacaggaactaaagattttaactagaaaattcccacagattgcgccaaattgtcttaccaaaaacaagataaacacttttatgagcgaaatggaaggttaatcctagttaaacttaataactgtcaaatttgtgaatgtggtgataaacgaaagaaataaaggcgccgtaatattaaatatcggaaaagatattgacgatgatagacaattaatgtatgagtgggtggaataaatgcatgcaatggcaagaaacgtaataatagaatatgatgcgcctgaatatcaagcagtgatagctagcaatctcattgtcaatgaagcagatgacgagatacatggatccgacacaatattcttggatcttgtatatgaaaaggtttcttttaacttgggaatcaatagaaaagacaagaaatgtatattctttcaatagtcaatgttataaagtgttctctctcaagagttttcagatgcttttttcctatgtataggggacattctttaaggaactctgaaatagtacaagggagggaatattttgttagaatattcctttattctaatttaaagttatactaccattacaatgggtctctcataacgacctcgttcgaaatagagccttcgaaccttagtgtaggccgacctatgctctgaccttggtcgttatcactattaagattgatccaaatttcgaccaatacaatagtcccatattgttcctctacatgtaagccaatctaaagtttcttcaaatattgatttatgcaactcctttaagtttggaattggagatacttcttatttaaattggggataagataccctaccctacctaaatctttaaaaattgatttctttatggggggacactgccatgaaatgaaattgttgggaccaaatttgatattgtctatctttttaattttaaacattaaaggtatcattcatcttgtctcggtcagaaatctctataatagtcatcttttataacactttattataacgaccaggttttctttggaatcattcatcatattatattataatatatgttctctataacatgacttcactatatcggctaaaaaatcataacaaacgatattaatataaaagagtttacatactatataagagttccaaaaagtgaaatgtaacttattatgatctttcttaaattttacaatattcaagttgtatatactttatttttagattcaacaaattctcaactaaattagaaatttattaataaacaatagcaagattaatttattaagatagcatttccatcaatattgtttcttgctcggagagactgtttcacacagacagttttaaatcttgaaaaattgataagaggaaactctcctccccctttccaccaaaaaattactatatattttaaaattgtttcatatttcaaacttgtaataacataattttttcaccaagttatcacattaatagacgtaaaaaaatattttagaaaaaggttcaccactgctattctcatctaagttgcttggacttggttgcgggtatgaatccgagtatcagattcggcaaaacctaaattttaagaagcgggagttcggctaatacaaaatagagatatataaatcttgtaaattttgagagatattctgtgaaaaacttacatgaacattgtagaatttaatctttcattctccaagatagacattatcctttcattgtcctaaatctattttattttttattttgagaaatcaaaatctcaatctttcatccgaagttagttgaccgaattcgagacgtatcccgtcaccgtcccgatacggcaccaaaatcgaagagttcgcgcaacttagattctcatagtttgaaatatctttaattatatcctcttcaatggagttgctttccatggtcaagtgtagcatgttgctatgcaagttggacagtcaagcccatgccttttcacttaaagcagattatgtcaggtccttttcaagtgtggatagtccattagcaattttattgggcttaaaagtgactctaggcccagtctcaaaagcagacaatgtcactgggctcaagggaggcccaatcaaatcagtctcggattgacgatggaaaaattatgcgacacatcaaatatttatacgttatttaccatttgtagttatactttcggcaaatttaccatccgtagctatattcgaattttatagcaaatccatgaactaagagattaattattttgtgccgaaacaagcactacaaaaaagggtatatttatagctcagatggtcagaatgtctgcttaactaaggtcttgagttcgaatctcaacaagaatattttttttcttctgtgtttctgtatttcgccttagttgtattcgttgcggaacaaatatagtcgttatatattctcatttatgatagctatgtttaggggtagcaaaatggttaaaagaaaacagtctcatattatccactaaaaaatgggttggataatgaactgtttaaaaacgggtcaaatatggataagaaccatattatctatttagaaaatggataaccaaagtaaccaatgaataatcaatggatctaacttttacatttgtaacgcctcaaattgggggtttcttcaagctaaggaaactaagaactctctcaaacgtggtcatatgcaataagtcctggataatatggttaaccatattattcgccgattaacccatttttatccgtattatatatgggtcgggtcggataatttgtccgtttttattacttattttcgaaccgaaccatatctgacccgacccgacccgcccatttgccactcctaagtatgctgttgttgtgatttctcatttatgctgagaatttttttgaatctatacgccttaaatttgaaaatcaacatgcaaaacttgttgataatatttcagaataaagtcaaacaatttttaacgaatagaaatttaaaaaaaaaaaacacacattaaatttggaaaaaataaacagagaaaacaatctagttagacactaatcattaatactatcaattattgattttctcgagtaccaaacataaggtacaaatagtagctttcttatgcctaattttaattatgtggtttccccacaagttggtcatgtatataggtgtttaacggacgggttgggacgagctggatacaaaaaacgtcagtccgttcggtaacggatcgggttattaacgggctagattttacgggctggtggcgggctgggaattttcgggttctataggggtggtacgggttcgcgcttaacaggctcgggcggctcgggctattttttttaattaattatataattatttttcaatgttattgatagtttttaattaaattaacaggttaatgtactgaaccgggctgcagcccgttaagaacctgttacgggcttaatgggttgtagtgggttcggtgcaccgtttttaaaaatatgtacgtttaaaagccgttatccgtttaaccgggttgttaacgggtcagcccggcttaacacctatagtcatgtacttgacatcattatttttagcatataattagctcaaacataatgggtttatcaagtttatcaaccattgaattcgttagtatttattcataacaaccttactatgtctataaaccttactatccattggttaaatatcaagtcaataattttgagaatattgcacgataaatatgagttcaaatataatatttattaatattttagtaaatatatatatatatatatatattatatataaataaatactaagtgcagatgaactcgttatcaaaaactaaatccaccctaacgataatttagatttatgtatattgcttaagcttattacacttgggaattagtgagaggtgtatatactaatttcaattaacttaagaaagtaaaagattatcgtccacttgttggacataagaattgtaaaattccaaaaaaaaagtgaaaaaaattttcaagtgaaaatggtatttgaaaattaaagttgtgtttgacatgaatattattttgggttgtttttgtagttttatgagtgatctgaatgaaaattttgaaaaacagttttttgaagtttttcaaattttcgaaaaatttcaaaattcatgttaaagtgaaaattaaaaattttatggccaaacactgatttcggagaaaagtgaaaatttttctaacccctttacacaaatgtttcaaagtattatttattggccaaagttgtaatctatatattatgactagccatttttgcccttcttttgtataccttttcttaatttcttccatactaagtaaacaaacaagtttgttttactaatcattttatgtatgcatttaattatgtcatgtcagtcaacttctttaaataagagtttccttagaaaaatagtactattgaataagctgaaaaaaagaaaaataaaaaattacttaataattaagaatatacaacttttgcactcatttaaagcttgtatttcttgttttattatgtagttatttgacagcttatgttgatttcttaatttttaaatgctggtaaggtgaacaaaaagcttatgtgaaagcaggatactcgatatttaaaagcacatgacatatgcatgtaaagatcgcacggagcgccttatttggtcacccacatttaatttatatcaatgtttttaaaattatttaatttataccctaatttttacaatttgaggcgcctccttctttttgctacctgtgcgctcctttcttcctcttttcttttctactcttcaattttttgtaatttgtagtatattttactgctgatttgctcatagtaattaaattgatcatcgaaaagaagtttactgcgaggaagtaagaagctaacattgttaaagctactgtagaatttaaatttctatccctaaattcattgttttgtattcaataggtgttcagattgttagggagataggaggaagaagaactattgcgcatctttacattagattatagttgggagttgggacttatgtctagatatagggaaaacttcagccaaaatatgctgaagttcagcaaatataaaacaaaacttcagctagtagaatgcttaagttcagcaattacaaataaaaacttcagccaacactaagtttacgcgaaaaacttcagctaaaacatgctgaagttcagcaaatagagaacaaaacttcagctagtacgactgtatgacaaaacttcagcttatttagtgctgaagtttttacaaatgaactaaataacttcaacatcttctgctgaaatttttgaaaaagttttacgataaaaccattgaatccaggacaaaacttcagctaaaacatgccgaagttcaacaaatagagaacaaaacttcagctagtagaatgcttaagttcagcaattacaaacaacgtcaggcacgtctactagaatgctgaagtttgtgtgattgcctttgctacttcagggccgtatgcctgaagttcacgcgaaaagtgggtatgcttgcaattttttttcaaagcgagatataagttaaaacgtgacccaaaaagtaggtatagatgcaaatccctcacatacatgttatgaagtggaaattttcttcttctttttttaactcaagttatttttcgtgaacaaatcaaaggagagaaaatcttgaacacaaaggaaaaaataattcatatttataaatcactcattaattaaagttatattaacgttaaagttgtctccagctgacatttatagttcacgggtttgagtcattgaaatagcttttaatgtttgcattacggtaggttgtctacattacaatttaagtgtggtccttcaccggaccctgcgtgaacgcaaaatactttgtgtatcaggctgtcctttaatcaaaattacattaaatattgaacaaactctatattgacattctcacttagtatctcacttagtacctttcatttgattttttttaatctaattgaatttgaccttaattattagatagagtaattttcagaaaccactattgtttagtaatttttaattttctatagctaccgtatacataattatttcctatatctattttttagttattatggtagtgtattcgttgtattcgctgtcgtattcttgagtacaacaacaaaaagcgcatgagaatcagggcagtccagctgcgcgtgcatgtattcacatgtatttgcgctgctatattcatgaatacagctgtatgcgcatgtattcacatgtatttgcgctgctatattcatgaatacagctgtatgcgcatgtattcacatgtatttacgccatatattcatgaatacgataatgataatcaccttaaaaataaatatgtccaattgtctaaaacagaagaaaaacataaatagcgtatttcatgcatcataaatacttattttgctataaaatataaaaaatcaataaaaaaaatattttaaaataattttaacttataatacataaaatgtatatttttgtcgtacgaggtaaaatttactattatatttaataaccttttattgacaaaatcatagtacgaattgggacctttctcgaataatctattcacataccaaactaggaccaacaaatggcaatggctaatttgctaccgacacaaatacataaaatggagaaataattacaaggacatgaaaattaagtaatttaatgcataaatataattatttaatattaaacagaaaaaaacaaaaaagaattgatgggctatattgacaatcttccaccgaacctcattttattagtaacaaataacataataaaaatacaccaacaaaaattatggtggagtgataaatactctttcatccttaattagagattttgaattcgagtccctagatatagagtcacatttgttagagagtactttacctccaatgtaagacttctcggcgggaatccgaatttaataggccctaatatggatacaaggcagcggtgaaaaaccaaaaaaaaaaatcataaaatacttataaaagaaattaatataaaataaaaaattatttagcaacctcctagattggaaaaagacagcgcatgttgtactgctatctatagacagggacacaaatgtcaatatctctaaacaaaggtccatctttgtattttcatgcctctaaatctctactctgctttagcactctattttattagcaactactaacagcttgtttgatggttgttacgcatcgtttcataatgtatcgtattgtattgtatcgttttataaatgtaacgtttagatagattgtatcgtttgttgttgtttcatgatatcacgcgctggcaatatgaaaaagaaacttgcaatattataaaaaaattatgatatagggtaagtttattatataaaaatgtagggtaaatgataaaataaaattatttaataataatgaagggtgatataagaaaaagacaagataacgacgcaaccacaccaaatcggtcgttacataaagtggtacatttcgtcgttacgtaacgacgaatttaacgatacgatacaataaaatttaagtaataacaaaaataaatatcgtatttaaagtaacaatatgatacgatacaataggtaacagccatccaaacaaggggtaatacaacgtatagcgtgcacggattacattatatttaatttaattctactttaatcttttctagtcatatactattatttattacattcattttgatgagtcttagtaggcgtttggacataagaattataaaatttgaaaaaaatggtgaaagttttttcaagtgaaaatgatatttgaaatttagagttgtgtttggacataaatttcagtttgagttgtttttgaagttttgtaaatggtttgagtaaaaattttaaaaaacagtttttttgtagttttataatttttcgaaaatttccaaaatgcatcttcaagtgaaaattgaaaattttacgaacaaatgttgatttcgaaaaaaagtgaatttttttaaaaaaatctaccatcaaattttatgtccaaacgggcacctatagttaaatcataagtttactttctaagaaaatactagtactttctttttttctttttaaccatctgattttcactggtcgaactaatctaaatattaaaaggagcaaatcctatatttttaaaagattttttatgcctaaaactcaaacttaaggggtggaaaattcttgtcccttcattacatttgtcggatttctttttagtctgtgccaaagataatgaatcatttccttatttgaaaataattaccattaactgaaacattactaacttaagctctgactctgcacgtgaaatctcgtgtgaatcaacaagtactccctccgtttcaatttatgtgaactcattttattgaatatggaatttaaaaaaagagaaaagacttctgaacttgtggtgcaaaatgaagcacatatattttgtgtgactataaactatagcataaaggaatttgaagaatactattcgagccatgggatcagatatgaaaaaatagttcatggaaccccacagcacaacagtatagctgagacgatgaaccgcaccattattgagaaggtgagaaacatgctaataatggctaaactgcccaagtcattatagggtgaagcaattcagacagtctgttaactgatcatcatcagttccattggagtttcacatccaaagagagtttggaccaacaagaaggtaaactactctcatttgcagagcttttgcacatataccaaaagagcatagaaaaagctagaggataaatccgttccctacatattaatcggatgtagacttttgtcatctaagttgcaacactaaggggtcggttggtttgaatacggcttatgccggaataagttatactggtataagttatgttgggataacttatgctgggattagttatgctgggattattttttatccattgtttggtatgttatattaaatatgacaattgcataatttgtaagaagaatgtataagttacaccggtgctaattatcctaccctctatgatgtataagttattctggtgttaatttcaatcctgagataacttatacctggtttgctaaccaaacgaaggattaaggtggtattaaatttttataccagcgctataccttcttatacctcatactaaacgaccctaaggtttctatatctaacttttaaactcgagatatctaattaaagaaggcggaatgttaatcattttatttgaaagacaaatgtcattataaatacataataatatgtccttttttgtcttttcaaatccctacttctccactttccaatttcatcacctcctttccactccattagcgacattacactttcacactccaaacacacactctcctctttctttagagcttcatttggattctcattctcttaaaaaaatgggttctcgaaccgggtcgcaccagctaagcaacgggttaattgtctcgggccgacccgaacaacacaaggaaaaacaacctacagtcgcatcccgtgccgttccttacaccggtggcgacgttaaaaagtccggtgagcttggaaaaatgtacggcatcgatttctcaagtggggaccacctccaccctctcgggggcccaccaattctgaggcattcatcttcttcccagcataatagtggatccggacccgtcagatccgggcctaactccggcccaattccgaaaagatcctcttcctccggttccggtccaataatgaccccaattcagcccaccggtctcattacctccggtcctttgagttccagtattggtcgacggtccggccagctcgaaccgaccggttcgtttaagaaagtagtctacggttcagccgttaccagcttgagcgatgaaattaaaatgggttttagggtttcaagagtggcaatgtgggttttacttgttgtgttactaatggctttaatggcgggtgcttttgtgatggcggcagttaaaaaatcggtgattttggtgggtgtaggtggaattttagcgccaattttggtgattttactgtggaattatggctataaagaacgaggcttggtgggttttttaagaagatttcctgatgctgagcttagaggtgctgttgatggacagtatgtgaaggttactggggtaatttcacactcttatgcacattttatattctagctggcctatataaattataaattgtgaattttaaaattaaattctttctaaatataagaattaagtatcatttttttttggaaaagagtaaacaggaaagtgtatcaagaagaaatattattttaattctggaatttgatttcctattaaattttgtttggtgatgtactgatgttgaagtgtatattctgttttttttagttcatgattttgtcattaggtggtagttatggttgtttagtaggatggattttttggatgattcctccggtttcaaatttggtccaaatcagtgacttttttaaaaagcaagaaggtattaaagattttcccaaatttacccttgtctaataaataatttgaacaaattcatagtcttccaatgctaatgtatttaggctgaggagagataaatgttaatttagtcaaataaccgtcataataaatgtaattaagtgatcttcttggtgtgtcaaaaccttaaaatcacttatagtggagcggagtaagtagttttaagattttcatttaccatattgcccttgaggtgaatgaccatgtgtgtgaatgactttgagtgtgcttgagggatatttgttaagctttgactttgactgtcacttaaaattatgcttaaggaaaggttaaagcacatagctttatgtggtgttttagtcttgtgaaatttggctgctaagtattgtgatttgaagttactctgaagtttttcctttgattcttaatgtggaagaattgttttaaaaagtggaaaatggaaagaaaaagggagggaaaatatgatataataagtggatatgtactggctgctgatgtttatataattttatttttttaataagttacttcctttgctgaagtatatataatttcatttttctatttatcagttacttccttcgcagttctaatagactgttagttatttttagagaggaaatttgaaaagatatgacgaagtagaactaccttcctgatatcttgtattctttcattaactattcaacagagaaatgcctttaatctccttttttatcttataaaagtgtggcgccctttcctttctcttcgtctttcctttcggtaccagaaaataagtactgttttcgtgcacttcctttaattgtatgtagctttcaagttctaattatctcttggtttcctgtatcaaagtaatatgtactgttctctcctttgcgattcttatcgtacctaaaacaggagaacttatgcttctttcttgattgctttcttttccaataaaccgtctagccggatgtaccctttacatgatattatgagatggtctaagaaataaattttgctcctctgttaactttagtggttgttctgacctcatactttttgtttgcaaatcgtagttctagataatgtcatgagtacttcatatagcttttcaacttgtgcatcacatgtgaaatgaacattcctaacgaataatctttacttttataagatcacttaatttttgagaaagaacttttataaaatcatttgtagaaagattctcataattattgcttaacattttcacctcgcaaatctcaagatttgtagaaggtagaagccaatcataaaatataaatggcagtaggaaccaactatagtatttaggcgaaatccgtgtgagcattgatacttactctgcagccttttttttcaattatgaccttaggtcttaaatgacaaccaaacttgtaatatttaaaattttgaattattagcttaaggtggttgtgtattatcttatatagaatacatctttacacatctttgagcaccttgctgtaaggaacttttgcagtttaatagaaatgcgttctgcctcgttaggcagactgtaaaatagataactaatgccctgacattgtcagggccatataatatgaagtcttttttatgtaaactaatcaactttacaacaatagtgacaggtgattttgattgtcagagtgtccaattgcaatacagccatttctctcttgatccagttctccatctcaagattaaattaaataaggttcaaattttagaaagttaagtacatttgaatccacgtgagaagtgaaatgggcagcgagtatggagcttgtattttatatatgcaagcttggaagattgattctttatttcctcatctgattcttttagtataaaggcaagcttgaaatggaaaccatttatgggtctaaaatcgagatgtgtgttaagttctcctttcacaataacctgatggaatgactaaataggaattattattgcatttctattaccccctcaatgtagaggttttcagaaatgcgcatttctaatccagcctcttccacaaaaggaaaaaaaagagaatgaatcatccaaaacagccataccaaaaagttgacaagtactattctttacacaaacaaaaataaaataagaacaaagtggcaaaggttgagcgacttgtgacctaactcacaacttcgagctttgtgccactacgaactaagcatagcttaagctaggagtgaaccccttatcctcgaggttcaaaggctgcagttggtcctaaaaccctcattattagtaatctttgagtcatgtaatgcccttattcggtgcttgtggaaggtagccggtacccgatggagtagtcaaaggtgtaggacaactggctccgcgaacaccattataaaaaaagggtcatataacacctgtaaagtctatggtatagccgagagtcgctaagagattctgataatttaagttgctccgacatggcagtttaggtgccgcacccgtgtcgacacgacactagtatgggtgtgggtatgggatccgtacctgatctggtcaaatttttttggtactttgaccacgacggacagaaaaattcgagatgagatacaatttgattactgaaatcagaactaaaactagggtaaatttgaagaaaatagcatatgttatctaggaaatcaattttttacttatctacaacttgagaagaaaaaggaaatccacactttacaagttatacgtaagtattccacaaaatttctcataaattagagagaattttatttattttaattatttttagccggatccctacactcatatccgtactaggatccgcatcccgaatcttaaaatttacatcttgaaagatccgacctaagatccgcacctgtgtcggacacctgcacccgcgtccgagcaacttagctaataattgcagttgtttgccaacctttaggattggatgcctcatttatattttccaagaactaaatccagcttgaaactattatcctcggtatttcctttaaaacatctttttcataaaacttggacaatttgagggatttgctgtattcagctagcataccatgtacccttcctttgcttcttgttgccccaagcctccaacaatagttctatgtccttgttgctttgctctgaatcttgtttccgattctcatacataatttactttccaatagacatggtagaaattgaacttaggaaatctgaaacctagggttgtggacttctaatatccatgttgctactccagaagatggaactaacctcctgtttaaatcgtgttttaattttcttttttcatttaagtgaaaaaagaatcctgtttattttcgacaggcacttcaatctcattaccatctaatgaagacttcttgttagttatactagcttcacaatagcttgcgtatttattaatgtttagactgtgatagagttgaggacacctgctagaattctattctttccttttaaggtgtccgtctagtttttgcatgaatgcccacaggaagttttaccattatgctgccttatcaaaagttgatcattaaactactaatgaattccttgtgaatcctgtccttggaaagtgatcattgaaaaagaaaattccatccatgtgaagaagcccttgaaaacaaacctcagtgaataccacagtgtatttaagttttgttttgagttgtcatagcatctcttgagatagtgtcattgtggtcaaccatccatttctccgccattaaggtcttgcattccaaattctgctctcttcatgtgttatttagggaataattttaattgttttcctgtaggttgcacctgtggcagttaccccttcaaacttcttttcagcggataccaagatgtgtatatgcttctacagaattgcaagaatacaaaggttgtggtggaaaatctgcacatcccagacagcgttgctttcatggggacgcaggcattcggaggttagtttgcatatcaactacaatttgagtatttcttgatttggtcatagcactcagtatcaattggtatcagcaatctctggatgctatttcaagtacaatagttattcttacataacagtggcacagatagagataacattgatacatgtattagtccatcctcataagaagtttacacaaatgcttccgagaggttgccatagtgttataatcttatatggctggaaagaaacaaaggatgtttgaagcagaaggacaaggaaagcaaatctctaggattaaaaataattgtctatataatttgtatttctggtgtaagaacaacatattggaaaatgtagataatactttggattttatagagatgctagggaggatattctagtctgtttttgagccttccttcttgtacacttttataccaacttggtactttatttaattacaccccaccccacccccacaaaaaaaagaagttatatgggaacttgaagtaagtattggaattcagggcacataaggccatggactatctatgttcaaggttgaacaacaaacttctgtgatttcatagagtcaacagatcttttaaccaccatcatatgccaacttccaggcttaaattttgggaaatctcttgacttctacttgttagaatttgctaaagttgtagtccagttactgttttgatgcttaacttccttatacacaaattttatacatagtatttaactcctaagaggtcataacaagtggtgacaattgatacttgtcccttcccctcgtcccaggattatgtactggtcatgactccaaagattatgtctaatgagaaacttatgtatgttgctgacttctgtgtgtcttgtgataacagaaacatgttgctgatttctatatatcagactttcagaccggattaagagcactggtgaaggcaggttatggagcaaaggtggcgccgttcgtaaaaccagtaacagttgttgatataacaaagagtaacagggagttatctcccaacttcctaagatggcttgctgatcggagcctctcaagtgacgaccgtgtaatgcgactgaaagaaggtaagctgagttcattctgcgattcgtgtacttctgtgcttctgttactcaacataaggttctttatggttgtttcaaaattacagttacatcaaagaagggagcaccgttagtgtcatgggcgttgtaaggcgccaggagaatgtgctaatgatcgttccaccagccgtatttcaactggctgtcaatggacccgttgtctccttccaacctatgtagaaggtctcatcttgacctgtgatgatattcagaacgccgatgtaattcctgtataggtttgatcgtataataccaattttgattgcccaatgagttatggcgtcgcgatgccagcaaagcttgccttgtttggtttctatgcaaatattcaagtgtatgtaagattgcatagcagaacagacaggcaaaactgatatctttgatgtctgaagttgatagtcctatgtatatcaatgttggtggagttagtaaataccacgtggaattagtcgaggtgggcgcaagctgacctggacactactgttatccgaaccttagttcgtgtagattatatatctagtttggtttttagctgcaatatgtatattaactgttatgtttatatataagttgacaagctggttctaatttattcactgtaacaatgaggtgataattttttttgttccattaaagtatatgaattttgttgattatagtaacaataaaataattaataatcattataaataaatttacaaagttacttttttaacttactttacacaatcagtagtcactaaactttattcattaacataaatatttccaataatgtaagtaataacatagaaagtttattgattttacttttgtagtaggtaatttcaaattttctattgatttagtgtcacaaaaaaatttagttactttactttaacgtggacagccttaagtagtgtccatgtgtccagttggttagtctccctcttgtccacaataaatgagtaatttgtcttttattttggtccaaaataaatgtccatttatataatcaagaaaaaattcaatttatttttcaaaattacctttatgtacggatctctaaaatgtcttttactcatcacattaaattatacttcaatattgtggaccagagggtaattgatttcggattccctaatttaaatgataacagtatcacacatttttcttcttttaatttctttctgctatttttcttagctttgtattactccttccgtctcatattaacagtcttgattactaaaataattgtctcgaattatttgttattttagaagttcaaaacaaaattaattatttttttccttttttacccttagtaataattgtgcttgaagatggagataacacataaatagaataaatattgaataaagagaaatcatatcttaagacataaataagggtagaatagtccaatcccttttctgattaatatttcttaaggggcgtgtaaaagagaaacacagtgtaacgactcagctcgctagtggtattgtccgctttgggcctaggccttcacgggtttaaaacacgctactagggtctaacgcttgttaacttatatacccagcatccctcttgtgttttgtcgatgtgggactctgtctaaagactggggtgttacatacacccctcttatagactcaacgtcctcgctgaggtttgcctcaccgcatgagattcgcctagactcagcactgaggtttatcccgcctaaccgggatttcctaaatgcagttaaactctgacccaccataggcaaggctgacacaagagtggctttaataccatcttctcacatcggcaaaacacaagaggaatgctgagtatataagttaacaagccttagaccctagtgacgcgttttaaaccctgaatgcctaggcccagagtgaacaatatcactagcaggctgggctggtccacgtagtaagtacattttatactgttataacaagtaaaataatttttgacaagataacaataaacaaaactgatatttctgacaattctttagaagcgcgaaatggctgtgctcctgcctccttaactgaataactgaatcaagattccattcattcccctgtgaacgttacacacacactctctctcacacacacacacactctctctcacacacacactctcgctctctctaatacacagcttacaagaaagggagattaaattttcaagactcattgaagggagctaagaaaaaggaaaaagaatcagaatgggtagaagaaaagatcaagatttcttgattttgtgtattgtaggattatttgcatttatgggaatgttaacaaggtgttggggaagtgtaggagtgaactggggtacaatggcaactcaacaattaccaccaaagagtgtggtgaaaatgttgaaagacaatggatttgataatgtgaaattatttgaggcagatgacagtattttgaatgctttaattggtactgatattcaagttatgcttgcaattcctaactatatgttacatgatatgagtgctgatcctttaatggctgctgtttgggtccaagaaaatgtctctgcttatgcttacactggtggtgtcaacatcaggttcaaaagtttcatttcatagcctccttgtttctttaatttttttctttattactaaaaatcattgaaaaaaaaagcattagtttaatatactaggtgatttcatcttcctatatgattaaatggctaactatccggtacctgtgctggtgcgagccggtgtggggttgctggtgcgtgatggaatagtcgaggtgtgtgcaagctggcacggatagcatcgtcataagaaatgcaatagttaaatactaggtgatttcttcctatatgtctaaacgggaaaactattcggtacctgtgttggtgggaggtagcaggtacccgataaaatagtcgaagtgcgagtgagctggcacggatagcatcgtcataagaaatgcactagttatatagtttgtagaccgagtcatcgtcgtcgtcgtcgtcgtcgttgttatatatagggagacgaggtaagggaaggggaacacggacaatataagaattgaatccacatctgctgtggtttgaacttccattatccttggttgttcaagtattttcctttgttttatcaaaatatatgaaaggggagtcttggcgtaactgctaaagttgctgccatgtgatcaggaggtccgggttcgagccgtggaaacaacatcttgcaaaaatgcagggtaacgttgcaaacaatagacccttgtggtacggcccatccctggaccccgcgcatagcgggagcttaatacaccgggctgtcctgtttttaaaatcaaaatatatgcacttgttaaataggagggttcttgagagttgcttttaaatttctaagtagaaactctcagtttcaattctcaaatgaatgcaggtatgtggcagtaggaaatgagccatttcttcgaacatacaacgggacatatctgccctacatattaccagctctgaaaaacattcaagaagccattaacaaagcaggattaggatcagaggtaaaagcaactattccattcaatgctgacatttactactcccccatcaaatccagttccttctgctggtgatttcagaccagaagtacgcgatttaaccattcagattgtccaatatttgtattcaaatgatgcccctttcgtcgttaacatctatccttacctcagtctctatggaaacatctactttccgttagactttgccttttttgatggctcaaacaagcctgttagggatggcaattatgtttatactaacgtgtttgatgccaatttcgacactcttgtctggtcattgaagaaagctggttttcctgaagtgaaaatcgtagttggagaagtagggtggccaacagatggagataaaaatgccaatatcgaatatgctatgagatttaaccaaggattgattcaacattgtttgagtagacaaggaacaccagctcggaagggcaaactagaggtatatttatcagtctcattgatgagaacgcgaaaagcattgctccaggtaactttgagaggcattggggaatctttgagttcgatggaaagccaaaatacgagctagatttatccgggaagatgcagaaagataaaggattggtcgcagtagaaggtgtaaactatatgcagaaaaggtggtgttgttaaaaccagatggggtagataatgcagaagaagacttaccaaaaaatattgattacgcatgcagtctttcagattgcacagctttggggtatggttcttcttgtaaccatcttagcgcgaaagggaatgcttcctatgcctttaacatgtactatcagttcaagaatcagaatagttgggactgtgatttcgatggcttggctgtggtgactaacgacgatccatctgacgataagtgccatttccctttgatgatttctgttggtcattcaatggtgttgttgcagaagagattcctatgtatcatatacttgttgctattcttgagggatgtagtttagtattcttgctgctagagaagtcagtttgaatccaatgctgcataatatttgtattattgtttttccatttatttgctgtctcttacattgctgatattattttttgggttttgttgtcacaaatctattgtctctaagccgagggtctcccggaagcagcctctctgccccctatgggtaggggtaaggtctgcgacactctaccctccccagaactcattgatgggaatttactgggttgttgttgttgtttgttgtttgctgctgatgacttttgtctgtcttttttcttttctgtttcttaacttccttccacttgtatgtgcacatagtgacagtaaacatgatatactatagtttattagactattataggcgaaagctgtccaacattggatttgtaaagccatcagaatttaattcatctacctaggtagaaggctaggtagctgagcgttgtccttgctcgttccggtagttttaatgcattcctgagtgttagttttgtattttcttattattagatttctgtttattacttattgtttcttgagcttcggttttctgtttggtttattggtgttgttgcttgttgtatccttcctctctatctttcctgagtcgagggtctttccgaaaacagcgactctacctctaaaggcaggcagtttgcgtacactctacctctctccagaccctactagcggaattacacttctttttttttttttttgctatttaaatgagtatttctgttgctgtaatttgctgctgatgctgtttttactggtttctaaagctgctttaaatgctgttaatatgctttgctattgagggagggatttggggaaaattaatcaagagtataattatgaaaagaaagcaggaacaaatccctccttttcactgttcttgagccgagaatctatcggaaacagtctctctaccttcatatggtaggtataggtaaggtctgcgtacacattacccttcccagaccccacttgtcgaaattcactggttttgtattgttgttgtaaagcaggaacaagtaaatgttatttttagcaccaagataggagatagtatttcactaaatgcaaggaaagaatagtgaagggaagaacatagtaccccttgtatttcatgtgtagtttttaaacaatgaaagaagcacaaagaccatgattcttaatatcatcgtaatttcctcttatggaaagcgataacgagtttataaaagacggggggaggacctacgagaaagaagttacagtcttgcatgcattccaccagcaactacaagagtttctcctgttacatacgcagcatcgtctgaagccagataggcagtagctgcggccatgtcttgtgttgttccgagcctattgagtaatgtcttagcctcgagttctctcctctgaaaacaagcagcatcgagaattaatgaactgtgaacttgatcaaattttaactgacgacagatagagatctaaaattatgagagcttaccacattagcatttcccgtgataaattcagcaaaatgtgtgggtacaaaacctggcgctacacagttcacacgagtatttggagccatttcagccgcgagagcctgaaagcccacaagttagaaggaaattaggaatttgcaccatatggccttttatgaggctactctttaaattttgtccttgactaaatttcgtcttcaaaagtagttaaaagaagttttcttcttaggctaatggggacataatttaaatagcgcccgaagaaaaggccaacaacaacaacaacccagtaaaattccactagtggggtatgagaagggtagagtgtacgcagaccttacccctacccagaggggtagagagggcccgaaaaaaaggccatttgcgcaaatgccccaatacgatgtggttacttgatatgccagtaatgccaaaataagtaccttggtcaatccgagaagggctgtttttgtttactccatacattcccatggcagctgctggtgtgtaaccagcaatagaggaaattataacaactgaggaacccttctgaaggtaaggagctgcatcctgtaagtggttaaaatagaaaaatattatgtgccgcgccaagaacaataaaagtaatattcggacaatggaatccagaataaaattaaacatgtaacagaactacgcctaatctcaaacaagttggggtcggctgtatgaatcctcatttaccatgtgactccatttaggcttatgccgcttatctcatgccaatattacgcatatacaaattgaaacatgtgataaaaagaaaatattagcattaattgatgtcctcactcaaattttctagaggcatacattatgaaacatttgtctcttgaagttattcatatcaaatgacttacttgaagtaataatatcgcggctttcacgttgatatcccacaacttgtcaaggactggttctttaatttccaatattgcatccaccgtaggatttacagcagcatttgacacaatgacatctaatttcccatatttctggtaagtgacagatttcaatcagaaaaattggaccaaccacagaattcttcattcatcttgaaagtagacaaaattattacttcaaaggatgaaatgattaaaggaaaaaatgacattttaaggaacggttttaacctccaagaaaatgaacacactcggtcatgaataacaaagattcgtgaggaatcaagaatccaaatccctgccgaatggaaactacggtaaaaataattgaaagggttgtaggttaggagggagtccagtgtttttctacgttgtttccggggacggggctaggctgataatgttcgccttgggtgttagtggtttatgtagcttccacactattttctaaagcattattactgggtattgttattgcttttatatttatttttttattacttacgatactgatattattttatttttctggcttctgttgctgtgactaatctattgtctattgtctattatttattttcttcttattgagccgagggtcttttggaaacagcctctctacccctccagagtagcggtaaagtatgcgtacactctatcctccccataccccacttgtgtgattttactgggtggttttgttgttgttgtatgtacctatgcagcacctatgctggtgagaaaggtagcgggtacctggtggaatagtcgagatacgcctaagttggcccacacaccaacgttaataaaaaaaagtatgctcacactagaaaaggattagaagctaactagtttctttcaccaacaaatttaggaagtgaagaattcaagcaccaattaatttaacattcgtgcatatctcggttttaataacttctgagagttcaatagtatgttgtagatatgtacaatacatttcaactcaaacttctgaatttgattgattgaacaagtgatagatacactagcaggatacctgaatggtcttgtcgaccaaattcttcctttgttgtgcattggacacgtgacatactactccaaaaacttcaattcctcgatcactgagtttttgtactgcttcatcaacatttttctgtaaaatgaacagattaaaagaaccttcaattcaaaacaccaaatgtacaaagaagcggaagtcatggaaacagcctcttgtagaatgcagggtaaggatgcgtataatatacccttgtggtccggtccttccctggaccccgcgcataacgggagtttagtgcaccgggctgcctttttacaaagaagcaaccaaactgtatatagttcaaaacttgcaacaagcaaataaaatccactctaagcaaaattgaagactcagcaaaccatgatagtatttttacactaatatcgacttatgaaattcttgaaacattcagttttttcaataaatacccatcaaatatgcaatcaaagacataaaaagcaccaaactttggccaaattaaaacacccaaatgaagattttcacataaacttgacaagaaatgatgaaatatttcaacaaagatctgaaataatcaaacaccattttagaatatctaatctaacacagaaaaaggttcaaatttggccaaattagaaacactaattaaagaagtaaaggaaaaatttactggtaatgttaatttctattttactatttaaccatcagctatataagaccgactaatcgggattcgtgccacataggacctattaaagaggatccattaaagaggagatacaactacaacaacaacaaaccaatataatctcacaagtggagtctggagatacaactacaacaacaaaaaaccaatataatctcacaactgaggtctgggctgtgtacgcacaccttatccctagggtagggtagagaggctgtttccaatagacactcggcgtccttccctccaagaactcaccaccttgctcttggggtgactcgaactcacaaccacttggttagaagtggagagtgcttaccatcatagcaacccactttgtctcccattaaagaggagatgctcacgaatttcaccatttcatggcttgaacccgaaacctctagttaagggttctgacggaaataattgaaacattaaatagtgaattatgtgaaatgatgaaaaccccaattttagaatatgcaatcaaatacagaaaaaagcatcaaactttggccaaactaaacagactcattagaagaattcactgaaacttgacaagaaattatgaaatacaataacaaataaataaaacaaaaaattaaaaaaaaaaaaattcttcaagaaagcaaacctgttttctggaggagataacaacagaagcaccttctaaaccaagccgctcagctatactaaagcctataccctgtgtagaagcagttacaattgctacttttccttgaaatctttttccaaatttctccattgctgtctaacaaactcaaacactttaaaaaaaatattaaagagaaaaaaaggtactgattttcttgttggaattagaattgcaatagtttaatacttctaaattattaaaaaagggactctttttattcggattcggatctttggacgttgaaaattatgaaaatttatgtatttttatatatttaatatgaaaattattaatatttttactatgggaatgagtttaataaatatttaaaggcccacacctgttttgtctgtgtattaaagtagctgataaattcaaagaaacaaaaaagggtactccttccggtccaaaataaataatttttgttataaataataaaagaaaaagaacagtattgcagagaaaagtatgagaggtaattcttatttattttgaatgatttacaatggaatacgagccctctatttataaggaaagagtgacttggtcaccaagtaaaattcttaagatctttctaaaatatagacattcaccttaaataaaattctatttataacactttcattgaatgtctattcaacagataatgtgtctcgttaaaaccttaactgaaataaaacccaatgggaaaaaaatattttagtaaagaaaaaagagtacacatatttaataatacgtcttttggttgcctcgttaaaaaccttgcaaggaaaatccaatgggacaaaattttgtaaggaaaaaagagtgcaacgtgcattaactccccttgattagagcatcaattcacatccttgagccttcgtatcccaatcttgtgcactagctttttggaggttgatgtcaccagagatttgatgaataaatcatccatattaacttcaaataatatattgcaccttgaaatcctcgttatcacattatcatgcttatagagaaatgataatttattccacgtaacatttttctcaaatgtttagaaaaactaacttgctccctcaactttgggagtccatctttgtgcattatggtattaatcaaaatatagaccatacttaaataataataagatggaattatttggttcctgaccctgaaccatttgtgagggagaatgtagtatactttcgtatataacgtatatcaaaatgatgtagataatggtgttctcgtaagcaatagtttagctaaagtgaaggcactcattaaatcattttgctaaatgaaaccaacttatcaagatagaaaatctgaaaattatgctcgaaattaaattattgaacaagttacctcgcaaataccatgttgcggcttaataataatcgtacatgtaactatctcatagatgcatctgatgtggtatacatggcaggtgaatgaacccatattcaccttagataaattccagaattcaagggattcaatcccaattttagttggtataataatcgtgagaacaagcaaaataagagaagttataaagaactttcttgtagcaaaataagagacttcataaagaactttcttgttctttaatatttatccatgtgaattctcttttatttttgcacatcgtacttaaattaacatggctaaaatcaattatgtcaactggataagttatcaatattgataaacttcaagtttatagcatgatgtgtgcaattatcaataaactccaagtttattgtgacattcttttatttatgtagtacaaactggagaataaagcggatcacttttcacctatatagtaccccgctacaagttgtaataatagaagatattaaatctttcctttatttatagtctcaatataaccaaccgcttttacgatactttagaaactcaataagtttctatgagacctactacaatacaataaattgacgagataaacaattatattcctccaaaagagtaataaatggctcttctagagctttcagttaattttatactattacatattcatcaaaattcacacggtgaatatctctttcaaaaataaagttataccattatggtcatgatcaaaatcattataggcaagatatacttttgccatataataattgcattgccataatattttggttaatcacaataggtgcgtgattaatgatcattcatgccataataatgaaattattttcttatttcatttcaaacctcattctagcggtgggtgtggtatattcactactactagcacattcatattcttccaagaatgaatatgtattcataaatcagatgttgtcacattcacatcatgaatggatcatagtcatctatctatgctttacaaaatctcacgtcaaatagatgacaaatattattttcacaaagtgaaggattatgttgagaatctttatcaatggatgtggacgtggcaataaatgaataataattttgtaaagcatcttgatgacgattataatttcatttattgccacgtccacatccattgatacattcatagcaataattttgtcttctttcagacttatcacatactgctatcacattctcttaagggaatgagaatgaagcaaattcaatgggatgagttttcaattctttttgtgctcataatcatacatgaatttgatcacggtaagacataaaaattttaccacttcgggtgattataatttcttgaaaactctataagagttataatcaaagtttattgtctttgcttgtatttaaaatcaaattatagaatgtcaagaatttaaaagagaaaaataaaataaaatacttaccttaaatccataatttaatcatgaagggagttgatggaacaattgacgatcattatgctcaattccaaagcttctacccagtacaataaaagaagaagagaattgcagagaaaagtaggagggcaaattcttattgattttgggatgatttacaatggagtaggacccctctatttacagggaaagagtgacttagccaccaagtaaaatcctaagatctctctaaaatatagacattcatcttaaatagaattctatttataacaatttttttattgttttcaccacatattaaaaaattcaccttttaatattaattagcaaagaaattgaccatattaacatttactatctcttcacataaatattcctaacacgtactccaacttatttactccaagggcaattttcatgaaaaaataattaattcaatattaaaatatttaaaaattatttattttggtccacaaaaaagttaaaaaatcacttattatggaccagaggaagttgctgataagttcaatgaattaagaaaacatcttacaaaaattaataggagtagttgggaaattgttaggacattgataaaaaagtgaataaaatcatttttaatctttgctcaagaatgatttacttttttcattaattgctaccatatgtgcaacaatagtatagctaaataattataaaaaaaaaaaaaaaaaaaaagaaaagtgacacgtgtataagcaaaaattatttaagtcctcaaatttcttgcctactttgcttcttgtcttgggattctaatttttttaggtgtcacatataatttggaagatttttccaaaataaaaaacagagaagaaaaaaataagtaaaggagtctaatttggatcaatgttgcctaagcccttgcaaatgatagtttgctggcataatcttattaatttgtattcgcgctagatgaatttttatttaaataagggaaaaaggttaattatatcctctattttagtatattgtttatatttatcttctgttatattattggggttatatttacccttatcgttagccaaactttttaaaaataccctccacccaacgaaaagctaccggatgttattagaattatgagtaatctatcccatagtttggaatctaactttggttcttaaggcgagatttgacgataattacttgttgctcaaatacttaaagcataataagaaaatcatggtgcctgaatacttatcaacaaagactcactgttggaggaagaaatattcaacatacaaataaatacatgattgtcggaatttttatttctttcacttcttgagttcaacaaatgactacgaaagtgagaataatatgtgaagaagaagtgcagtaaatgaaagaggtttaacgggttattaatggatttttaaaaaaagatattttttgaatttggtacttttcattagttagaaggtatttttaaaaaataagaataaatatatctcgatagtataacgaagaataaatatgaacatatgccaaaatagaagagtaaataattaagcacatctcttcgaaatggaaggggttctacacaagagagaacctgcatatttacactaatccatcaacactacttgtataagagttttcaaagaaattatgatgttttgggtcacttcatccaatgctaaaattttaagttggtataatatatatatatataggttgtcttagtttgaattgatttaaacttacaatatttttttttctttgagatatgtggtcttaaataagccttaatatttatgtttgtaaaacttttaaaacttgccgcatgaaacctaccatatcatttgtatagctataaatgctttcttattaagaaaatattgaaacatgtcaatcttttctaaacaaactgcttagaacataaagtgaatttttttgaaacagatggaatatattgtatataaattatacatatattatatattcttcgattattagtttaaacattatgctaacaacatattagtagttaaggacggagctaccattagttacgggttcggatgaaccaaataacttttgtttagatcgtagttgcataaaaaaatttattaaattatataaatattcaattgcgaacttagtgattaaagtaaattatgaattcagtgatattcagaactcataaacttcaaattttggttccgcctctgttaatagttagccttgcattgtgctattgatactctctataactatatattttcttattatcttggtgttgttactgctttcctttttttttttcgagtcaaaaatttattagaaacaatttctctacgagaggtaaggcttgcgtacataatatccttctcagatcctactcgtaaaattaaagtgggtttattgttgttgtcgtctatgatgttgttgttgtaatatggttaaagcatgcgacttgtatgtcattttacacacacacacacagtcctttgtcgtccaatctaagttggcactctctctttccttatttccttcttcctccattattgcttcctaaaaccctaaaaatggaacatcccttcttcatcaatagcccgccgcctacaaacccatctgaagcattacgatggctatcaatcgccgaaaaactcctcacaaatcgtgacctagtcggcagcaaatcatttgcgacccgtgcccgtgaatccgacccgacattatcacacgctaccgaccaatactcggcataattgacaccttaatcgccggcgacaaacggattaacaaccactactttgattactactctatccttcaaatccctcctaatcaaacccaagatttcgaattcatcgccgatcagtatcgccgatttgctcttcttttgaaccctcagaacaacaattttccgttttcagatcaggcttttcgccttgttgttgatgcatttttcagttctttctaatcccctgaggaaaagtatgtatgataaagagctgggtttctttgttaatctttacccagttgcttctacgcctacccctgtgagttttgtgcaacatagtggatattctgaaatacctggttcgactgcagaccaagtgtttgtgaatttgcctagtcaagatcaagggtcacatgctgctggagtaagagacccacaagctggattttctatgccagttacatttctgaatcgtgaacaagaatctgtgacttctatgtcaagctcaggtacagagcaacaacatcagctgcaacaacctcgaacatttctgagacagcagacacaaccagtgacttctgtttcgttttcaaacacagatgaacaacctgtgacattcttcaatttaaaccaaccacagccggtaacttccgagagaagcttaatagagaaaacgagagaagcttaaatagagaaaacacaccatttggcaatgggttgagctcgaaccgagggcgagagacggtggtttctgttgagcagcatggtaatcaacagccccctgatagaaacgagaatgtggtaacttccgagagaagcttaaatagagaaaacacaccatttggcaacgggttgagctcacccgagggcgagagccggtggtttctgtagagcagcatggtaatcagcagtccgccgatagaaatgagaatgtggtggggaacaatgaaaacaggtctgctaatactagtgataatgcgagtaatgtgaaggagaaagaagggaatgcatcaaataagatataccaagcttctggactgcatgtccttattgttatgtgatgtatgagtaccctttggagtatgttgattgtacattttcgtgtcgaaattgtaaaagggcatttcaagctgtgagaattgcgtcccctccaccaattattgatggaaaagaagcttatttctgtagttggggatttatgcctttaggattttccttggagaattttaagaatagtggagataatgtttcgagctggtctccgttttcgcccatgtttacttgtcctgagctgggtggaatctgaataatcatgttgctagaggaaagaatgatgatgatgttgtgtttgttgagatatggaggctctttctggaaatactactcttaaggtaaattcatgagaaagttcaccaagaggatgagaagaaggaagagagaatcaagcccttcatttccaaatttacctttccattcttttatcacgatgatatgttgtagtaattttcttatgaagtaaactttgtgatttgcgtagatgatgaaactaatctgtaacttgattttgcaaactaatctgtaacttgattctgctgacttgatacaatttgcttcaaagaacaacaacatactcaatgtattctcacgggtggggtttgggaagtatgtatgcaaactcggctcataagcagtagagaagttgttccgaagacgctcgtctcaataaagcaaatttgcctcaaagaaaaaaaaaagaaaagaatggatagtgaaccagcaaatttaagcactgaatgtacgatctattatcataacgaaatgaatgaggttcgaattcgcagtgcaaagaatgcacgaaattgagtaaaacttacatcaagataaaagtagcattctgaatcatcattcatgcaaaactttcaacctcaaaacttcttgaagtggtgcaacattaggagatttattcataaggatttctgaagttcttcagaagctctgggatgtcatgaccgagcatgtcatcgacagcttgaatcattttaggcttcaatttctcaaaatcattgatactgtaatgacttaaaacttccctaaaatgatcaacacttgggaaatcccagctggtaaacgaaactctggacctgtgtcataaatgtaaattcaatataagcacatatctgaaatataaagagatccatttagcacaagtgtgttcaaaaagtgaccttttcaaatacgttatcaagattctgtatgagttttgttgggttttggattgcccatcaatgcaggcatctccttcttaagatggctaatatgtaggaatggatcttagcgctctggcacgtttaacaaattcattgatctgaatagtacaaaacttacatgagaatccaaaaccatctgggtacacaatgttaagcaaattgaaatgccagttgacgagaagaggtgatttaagaaaaggaggtgatcttactcgacgatcacaggccttcttggaatatctatcaagtcatcaagaaggtcatcttgctctttttcaaatagatcctttccagtagaccaacagcttcttcattaactggtttgtcgttgaaagagctgcaaagccaaaagtgtgagagcttattatacaccatgtaaagaatgtctatgattaaaaatgttgacaatattaactcatgcacaaaaggtgttagctataaacttttcttcatttcttttacagtcgacatgctatccaatgatcattctaagcatataatgtagcaactttgatcaaattatagagaactaaaaaagacctttctcttaccctatatagactcgcacaacttctggtgtgttcagaacctttccaagagaccacattaatgcaccataaactctcatcagctgccataaaaacaaaagcagaataacttttagaatcaagcaaaatcatcttgtgaagtagaaaaaagtaatataaggtaattagtacggataaatcatcatatcttacttgttgtgtatctacttgatctgccttgtttaatactacacggattttgtcctcatgacctttcaaagacgatataactcgtttgaattcgtcactaatatcaagtttatgtgggtcaaacaagaggagtatcatgtcacattttgcagcaaaccatgagatgacaccagtaaaatcataacttctctgtgtcctttgcttctctcccgataaaactccaggagtgtccacgaatgaaatatggtcaaggagctatgaaggaaaaattattagactaattcttaaactagtgtcataatagtataaaagtaaaagaaattgctagatattgactcacagaatgtggcatttgggagcattcaaattttgacaaaaatgcaccaccaaacttcgtcaaatcagtgaatggcaagtcgttgtgaacagctatagtgttgccaggaatgctcctttcatctggaccagactgagcaaaaaatcactgtaagacactataatggaaagatcacaacaatcaaattgagtcataaacatactgccatggaaacattattggagagaaaaaaattgcaagggcataaaacatatggaacaattacagttccctatttaccgtaaccacaatgaatctgtcggttgttggctctggtccgatgtgtgcacctatttcagccaaaagagtcaaaagaaaggaacgaatagaaggatcgatattaggtaaaagaattggcaggtattaaaatatgagttgagaaattagacatgaaattactaacctggataattgctctttagcaagtgtttgataaatgtggtttttccggtcgagtattgtcccaaaagcatgaccataggcttggcatcaaaatcgctctccgtctatgacaacagataaaaataagcacaaacaaatgacaagtttgacatctaaaaggttgttgaaaagtactactataagctttttcatctactcaccagagcaggagatgcaaaatcattaaagcggtaagtaagttccagcggcttcaacttttcattgtatagtctcttcaaaccatcagttactgatgtaacagcggtaagagaaggctggatctgaagcaagtacgaaaagaaaactagctaagtcaatatgaaaaataaccaaatagcccatttgtagtaaagacactattactacattgagggacaaggctttgggaaacttttggttttccgagttagccaagttacaaagaacagagataaatttgaaaaaataatagaaagctcaatctaaagtcaaataaaaacaagtagctctcatgagaatgagaaatcatcatctttattcaactatgcatgttgtaaactacaggcaaagaactgcagatatcagttttcctagtcaaccaccttaccatgcatagacataattataggaagaagactaactacacaaaacataggccaaggctacctcggcggagagtggaaaagattggacacgcaagatagatttcacatcaatatcccaaagaaatcaaaactcaccttctttctagattttctggaaaacaagttgattggtggcggtggctgcagttgtatagttcctgtatacattttcaagttaggcaatttagccaagacggcttaatatttcttcttgcttgagtaaaagcatcattggtgtgaaatgatattttatactgaccatttgtttcaatctttttcatcgacgaaccattagtcttctgcaacttggaggcaaaaaatacattaccaggcttataattcacaataagaaaataagatggaactgtagaagcacttacggataataaagcatccaaaccttccatagatggaggactcaaaaactccatattagctacaaaaataaataagagaaaaggaaacaagaactgagccaatcacgacaaactcacatgttctcatcagataattgactactgtgttgaaaagagtagatctaaaacttgcaaaaacaattgttatgcattattcttgccacttccacactaatgacttgagtgtgtgtaatccttgtcgcatgaattggtagcaatagtaagtacgttaactataaatttcagtttttgaaattgagtagcccaataagcagattggcagtaaatcccttctagtgtatataatgaatgtcaaaattcaactcctgaagtttctgaaatatctttcagctataatgcccagaaaataataagatagtgatttaagaaatatctggatcatacttctcctcgcttaaaattttaataggaaaaatacagctcaaattctagagcttatataactttgtgcctctgtgaacctaaatgcttcgatatggattataaacaccgatcaagaagcattacctttgctcctaaggagatcagagctgagctcacgtccttcttgtgccaaggagatcaactacagtaaaagaaaaaaggcatttaggttctacctgatcgatctatacagtattcatataaaaaaaaggttagtgtaaaaaatgacctgcattgcagtgacaaactcattgaaacccaaaaaaccttgtcgtttagtatctgcaattgcccaaaccttcatagataaagcacaacaaagttgcaaattagtcatttaacgctatcacgcaaggcaaatgtttaggaagtcacaaacaagcaacgcaaccacttatgcagtccaatattactttaaacacaataaagaatcttaatattccttaaactcaatgcataataagggaattttatgctgaaaaatagcaatacacaatctaatttcattggttggcaattcggcaatttttagaagataaagctagtaaacatttttaaccaaaagatggctcaataaataacaccttacataaatcttaattaagcaaccactagtccaccacattaaacttcaataccaaatgcaaaagactttaagatttaacagtgatatttaatggaaacagatggaatctcgataaacaatcaatagaagactagttctaacataagaaattactagagaaacgcaccaccaaaagctacaaaatatcaaaacaaacacagcaaaaacaaattataatgaaaacaaataacaaaattatgaataaaacacaaagctgtaagttcaaaaatgataatatacatatatgtctctctatgtgcgcgcgtgtatatcggaaattcagatatataaaacagtaaggttaggaaggtaaagagaccgtgtgttcaaaataaacaatcataaattacatttttaccaaaaataaaacaaaaaaatgcacaaaatcacaaaaatcagaacaaccgcacattatgaacactacctgcttgagttcaggcctagatagattcgacaatgaaaacagcttagtagcatcatttcctgtaatacgaccatcgccatctgcgtatagaaccaaaatatagcaataaaccgatgagatttcactgaaaatgtaaaccgaagaatgcttgtaaatgaaccaatgaaactttacctgaatcgacgaagttgaaccagttttgatagatcttctgatcatctttagagcacgaagaaactgaacttgaaacaatctccatttttctatacggagatgaacgtcgaagagaagaatgttggttcagtaatctaaaatttgaaaaccctgacagagggaacttactactatatttttttatatagcgctatttcaagatatcttacgacatcgtttagcgtgggtgggaaacagagtgctttttccgttcatatatgttcaattttctattttttggtcatcatatgtcaaatttcatgtaaaaatagcacgcgctagttagttttcggattggtcattcaaaaatagttattgtttgtaaagttattgaaaaatagccactggtttactgcaacaccgaaagttccagcataatatactggagattgaaacacttgtgtatgaacttccgccatattatgctggaccggtatattatacttgaattccagtataatatgttggaagtccagtatattataccggaactctagtattcagtatacttatgctgaaactccagtataatatactgcagctctagtatattatgcttgagtattttctgaattttgaacagtgtttttgttcagatttatctttacataaaaagtgcttaaatttcaattatttttgaaaaagtgattattttgaatgaccacttgtaaatctaattatgttttaatttctcccaaatttcattgttctatactttcaatttatgtgacgttttaatacttgtgtagatacaagaaattgtattaagcataaatgataaatgtaaggttaaattgttttgaacaaataaatattcttttttgaaatgaaccaataaggaaatagtattgaaatttatggagtaataaaaataattaaatagacattaaggtcaattcatctttaagaatatgaataaacataattaatttatatttattttatctcttttaaagtttgtcttgtaatgtttgcctcgcatggagataaatctaatacattgttattactctctctgtggatgaagtcaagatgtttctgtaaatattattttattttcaattgtgatttttcttttttggttaataattgataattgatggtgttgtgttcaaaatttaggataagaattgacttgaaaagaatatttgaaaaaattgttcttacttatccaattatctcaaaatttgaaattcaaattgtaacaaccgaacgcagcagccaaaagcgtgacactactatactacaggattgtctattcaaattaattaataattaattaattaatactattgctatagttcaaaacaaaacaaaaaaaattactactatagtagtactataaagctactttggttcccatatgattttttaattttattaaaatattttgctattacatgggtttcctacgtgtatcatatcgtatcgtattatactgtattaaagtgtattgtatcatttgatgaatacaatgtttggacatatatattgtttgtcgttcttttatgatatcatgcaccagcaatattataaagaaaaattatgatatgagttaaaattattatataaaaagctagtgtaaatgataaaataaaattatttaataatgacgaagggtgagatgaaagaaaaagacaagataacgatgcgatcacaccaaatcggtcgttacaaaaagtggcacatttcatcgttgcgtaacgatggatttaacgatacaatataataaaatttaagtaacaatcaaaacaaatattgtatttaaagtaacaatacgataatatataatagataacaaccatccaaacgagttgttattgatcgaaataaagtttcctttatttgttgttttttcattaatccacacttaccatgttgttaacaattctagtttttaattttctggtaaaataataatatagccgcttccaaaaataatagcccgctatttattttttttatatttaattagcgaatgtaattatttgtgatcaacgacaatgtgttacttgccctaaagtttttcttaatcatttgttttcgttttttcgaatatatatatatatatatatatatatatatatatataattttatttagagtgaatgtctatcttttagagagttttactttgaggctaagtcattttttccctataaatagaggagttttaccccattgtaaatcaccccaaaattcaataagaattccctctatctctttctctgcaatattgttcttgttcttttattgtttcataacacgttatcaacacgagactctaaccaattgagtagaaactttgagattgagcataatgagactctaaccaattgagtagaaactttgagattgagcataatggttgtcaatttctgtcatgaacttccttcatgattaaattctggatttaaggtaagtattttactttatttttctattttaaattcttgaaattctataattttattttaaatgcaaacaaagacaacaaatttgattataactcttatagagtttgcaagaaattataaccatcctaagtggtaaaatttatatgcttgccatatcaaattcatgtatgattgtgggcaaagaagtggaaaacccgtcccattgaatttgcttcattctcattccctttaagagaatgtgatacaatatgtgataagtctgaaagaagacaaaattattaccatgaaggtatcaatggatgtggacgtggtaatgacgaaattataatcgtcatcattgtgatatgagaataataagaattctcaaaataatctttcactatttgaaagtaatatttgtcatcgatttgacatgagattttataaagcacatatagatgattatggtcattcatgatgtgaatgtgacaacatctaatttatgaatacatattcattcttggaagaatatgaacgtgctagtggtagtgagtataccacatcacctctaaaggaggtttgagaaaataagaaaataatttcattattatagcatgaatggtcattgatcacgtacctattgtgattatgccaaaatattttggtaatgcgattattacaggcaaaagtaatagaagcaacatatcttgctataatatttgacatgaccataatggtataactttcttttgaaagagatattcaccatatggatgttgatgaatatgtgatagtaaaaattaattgagagctctgaagagccaattattactattttggaggaatacaattgattatcattcaattattgtgttgtagtaagtctcaaagaaacttattgagtttctaaagtattcgcgaaagcggttggttatattgagactataaataaaggaaagatttaattttctattactgcaacttgtagcagggtaatatgtatgtgaaaagttatctattttattctcaatttgtactacataaataaaagaatgccacaataaacttggagtttattgataattacacacgtcatagtataaacctgaactttatcaatattgataatttattcagctgacataattggtttatccatatcaattcaagtatgatgtgcaaaagtaaaagagaattacacatgggtaaatattaaagaactaaagttctttacgaattctcatatgttacttgttctcattaattagtagaccaactaaaaattgggattgaatcccataaatgctgaaaatatcaaaggtgaatctgggtccattcacctgccatgtataccacataagatgcatctatgagatggttacatgtgcgattattattaacccccaacatggtattgcgaggtaacttgctcaataatttaaattagagcataatttccaaattttctattcaagacagttcatcttgataaattggtttacatcacagttggtttagcgaaatgatttattgagtgccttcacttaatagttaaactattgcttatgagaacaaagttatctatatcagtttgatatacattatatacaaaagtatattacattctcccctcacaactggttcagggtcaagaaccaaataattccatcttattactattgatgtgcggtgtatattttgattaataccataatgcacaaagatgggttcccgaaattgagtaagaaaattagcttttctaacatgagagggagacaagataaacaattaagaaaagttacgtggaacgaattatcatttctacatctagatcatcgaataagataatatgaacttgaagttcataaaaggataattcatctgcaatatattgcaaagcatgccagacgcatttgctgacccaaagaaagtaactatatcctcattgcaaatgctcttattaagtcctagaaggacaaagtctatgctacgcttaaagcgtatacacaaatcggttcaaataaacttcattataaagaagacgagcaaatgatcgaatagaattggtttcatatgaaagacatataattttgaacctgtagttcaaacacttgaaagtgtaaagtcaatggtgtgcaatcactttcatgtatcttatatgtctagcatggcatgaaaacttgatgcaaatctgaagtctatttatatggcttatatgacttaacttatatgacaatccctgaaggatattgcttaaagcatatagaattcttggccatgaagtactaaatccaaagtgcaatttgtgcacatttgtatcttgctataattatcagcatgataatgtgatagcgaggattttcaaagtgcaacatattcattggagttaatatggatgatttattcatcaaatctctactgatgtcaaccttcaagaagctagtgcacaagattgtgatgcgaagattcaaggatgtgaattgatgctctcatcagggggagttaatgcgcgttatactcttttctcttacaaggttttgtcccactgagttttccttgcaaggtttttaacgaggcaaccaaacggcgcatttctaaacatgtgtactctttttacttttctaaaaattttttcccactgggttttattttagttaaggttttaacgaggcacattatttgttgaatagacattcaagggggagtgttataaatagaattctatttagagtgaatgtctattttttagagagttttactttgaggctaagtcatttttcctctataaatagagaggtcttaccccattgtaaatcaccccaaaattcaataagaattccctctctctctttctcagcaatattgttcttgttcttttattgtttcataacaatatatatatatatagatagatagatagatagtgaaaagtaacaattgtccatcaatatgactttcatcaatcagataacattaggttgcagtttatttgctatgaatttaagtgggtgtttggacataaggattgtgaaattccagaaaaaagagattttttttttaaaagagaaaatgttatgtaaaaattagagttgtgtttggatatgaatataatctggagttgtttttgaatttttgtgagtgattttagtctgtttggacataaaaaaaatgcacttttttttcgaaatcagtgtttggcaataaagtttctaattttcacttgaagatgaattttgaaattttttgaaattttgaaaaactccaaaaagctatttttcaaaattttcacttaaatcactcacaaaacttcaaaaacaactcaaaataatatccatgtccaaacacaactctaattttcaaatacgattttcacttgaatttttttttcactttttttggaattttataattcttatgtccaaacgcccactatgtgaacgtcttgaaaaacaatttttgaagtttttcaaattttcgaaaaattcctaaaaatttcttcaaatgaaatttgaaaaattcatggccagacattgattttcgaaaaaagtgaaaatttctcgaaaaaggtgaaatttttttatggccaaataggtagtaagttatatggtctgtcaatatattctgtctcaaataatcagtagaaataaatatacatacaccatcttttgatcaacaaacatgcattaataaaaatttgtgtgaaatataaccaatattttttccacaagaaatattaatacaaatccttaaactttcgcttgcgctatagagtgaggaataggagcaaaataatcactagacttgagaattttcaaaagaggcagcaaaacatctgcaaaatagtagaaaataggaaaatcagaaaaccaaataatatataggaatgcctaaagaatgagtgtgaaactattttaattataggtaaagttactaaatttatataatttcttattttcatttttgtcaatgggacacatgttgatgagccaactgtcgagaccgaaataacaatacgtcatgcagaagctaataaaataaactttgaataacaataaaacagacaacaaagagaacctgctttcgcaacttgaaagacacccagcccagccccttaatcacaaatgtgatcctgtgattgcaaatgcgagatctgcaactagacacaagcaactgttgagcatcatcagttgcaaactcatctgtaacacactcaaaactcacctgagcccatcgggctccaaatcgtacatgcacacgagtgtaataacatcctacaaacttgctcgctacctcaaatcatcaaaataacatcaaataacacgattcaatcatcaaaactcaagaatttcaactttaaaactcattttcacaaattctcacatgacgcaccgaaatgcgctggatcatcccaaaccccaaacaaacatgcgtacaagtccaaaaacatcataaaatctcgatcgaagagtgagatatacctttgatttagcatttcttttatgtgaggaaggcatgtttggttgtggctgcacaatagggaacttagcagctgctatttgcttttcctcttttactttgttgaaaattactgtaaatccttctccagatttgggatctttctcatcccatgctccaaattttggtactgatgctgatgaataataagactgtcatatggaggaagtggttcaattagagcatatttcttcaccactcaataaattcacaatacgactaggaatttaagcctgaattcacttataaaatagcaaaaatgatgcagaggtttattgcatcatcatttatttttgattaaatacgatccatgtgacaaggaggtcacgagttcaagtaggctgcatactatagacccttgtggtccgaccaggggcggatttagggcagcaaaagggtgttcaaccgaactccctccttcgcaaaattatactttgtatataaggcaaaatctaattttacctctatatattatgttttgaatccccttcacacagctcaaaagcacggcttagtcaaaggggttcataatcattatgaggtcactggttccattcccactagctaaaatctctttaaattttttaacctatttcttttttgaatccccttagcagaagtcttgcctctgccactgggtccgacccttcaccgaatcccacgcatagcgggagcttagtgcatcgagctacatttttttaagagataaaactaggattaaattcaaaagagaagaacccctcttattgaagtaggattaagtcatgaactacgtccacttttcagtagcgacatccccttgcacttaatatatagtgtaaacattaagtgcgagtaagtttttacgctataaaacagctcatttcggcagcaaagcatgaaatacaacaagcttgagctctcaaagcatcatatcttgttgattctccttttgcactgcctcgaactctcgctttttttcaggatgaatacgcgtgtaccctaagctttgctcattttaaccatcaatctaacatgtatcactatgatatatattaatcacttcatcaacttacttgctaagtattcttgcatgttcttacgaagttgttactaaattttatactaataataacactacacaaagtcttaattcatacatattatatgattctcaaccctaaatgatgattctatagctctaaccaaagagcagaagaacttacaagatcatcagatggatttctgctatttatcagtctatttggactaggtggaacgaatatattgctgcgatcattcttattcttcttagcatcagatgtcctgcgacgaacagttgtctcgttaattgaataaccagaaatactcttatcttcaacagcagaaagatttctgcagtgaccataattgtaccgatgaggcgtttcgattaaatgagtattcgctggagaaacattaatactagcatcttcatatcctccatatgcaaaaacctctggattctcctcaggatcatttggatttattatcttaccaccttttcctctgcgcgctttctcaaaatacgctgtgtatggcacattgtcaccatccagtttccgaacttaggaacatgtgatccctgctgcaatgagtatacaacaacgcttcattgttaagcaagttgaggtcggctgtatgaatcattactaatcatgccgctccatttaagttctctatattttaatataaatcattgacatgactaaaagactcattgaaaatataggacttacaacttatttgatggttattatgtattgtattataatcaaacctctctataacagcttcgtttgttccaaatatttttgattattttaccaattatattatggcataacactaaaattggttccggaaaagcttgagttttatagagaagtgttgttatatagggatgatgttatagagaggtctgactgtatatagtattgttttgatgtatatattgtttggatagatcttattgtttgccgtcgttttatgatatgtcatgcacccacaatgtgcagaataaacttgcaatgttataaacaaaagtaaggtacgaggtaatattattatataaaaaggtatggtaaaagataaaatataattatttaataataaaaaaagagcaagatgagaggggaaaaagaggtaacgacgcgacaacatcaaaccggcttttcgataaagtgacaactttgaatttgttctttaatcacatagtatcttaatctacaaaataagaagattcctaagatttttaacatccataatcaacagcacctttgccttgtaaaattgacagaactatttgattgtaaaggcaaacaatgcacttcatttgttatcacaaatgagtaattaggaccatacaaataaataaactaataataaatctagccataatcaagactaacaagctaattaaggtgcaaaaatcagaaattgaagagaaaaatttacttacagccattaatgattttggaattcttcttcttgttattgagttcttccattgaacaatgactaattgtgtattaagaaaactcaagatttgaagtgggaccaatttaaatttattttctttaatttatcggagatcccaatgaaattttggacctgctaggcaactagagaaattgttttgttggttacaactatttgtttccattgaaataaaacaaaacaagaaaacgctagctgatttcttctcgtatggttaagacttggtagacaaagttatctaatatttatgttgatagcaagtattacgtgaaataattgaagtacgtgcaaattaatccgagcacgaggattatttaaaagaccaacaacgactttaaaattgtctttttcattacatggaggaaagcaaaatgatttaattggtttttcgttgactcctcttttggagtgttaattgttggttatagttatttgtttctattgaaataaaaccaaacaatcttgagtccaaaattagactcttgacatggacgattgccagatatctttaacaaaattaagcgaaatgattcgaaagtttataggcgaaatggtctcgtggccacttaaatttatacgagattttaaagctgatacacgaatttatattgttctcatttaaacactcaaactgacatatttgctaactaataaacatatttagccgttaaccatgcacatgtgcaatgacagaagtgatatggacaaagtgtgtgtaagtcacgtaaattaagcgcgtgactacaataattttgattaaaaaatataaaatcagaagaaaaaagttacaaataaaaagaaagaaaatagactataaatgacgaattttggttggaaaattctacttattcaatccgactttttctctttgtctgatttcatcatttatatttttctttgacatagcttcgctggctcttttgttgccttgacgaaattttagtaggtggcccatcgatctttgatttggggtatgaattttatgaattttgttagaagtgaaagatagaatgaactttatggaaattcatggctgattgagtcagtcaagtgatggctggaatttttccccgatagcagcggtaaaatgtgtagaagaaatagtgaaagaagtaaaataagaaaagacatcttgataaattagttttaaaaaagggaccacagatgcacatgtaaaatagtaaatggtcttaggatttgacgtgttcttctttcaagcaattgagttacacgtgggtttatttatactcaattgattgagttgaggtgctaaaatgagaaaatccaaagtttaaatatcaactttaaaatctcgtacaagcttaagtggccaagaagctatttcgccaagtttatacgaaaacaacaacgatgcctcagttattttagactcgtgcatacaacttaacccctttttatgtcaatcgtctgatttacaggatgtcccctttgtttgggattaagaggtaattattgttgtttggttacagagtacattttttcaaactttgattttttctaagttttccaaaagtgaaaagacagttgaaatatttctttaactatatctaaatgaaaggtgaaagaatttatcctaaactatacataaatcatgttctttattagttttcatagattatatacacatagtagaatgtaaataacactgaggcttttacgtggaaaattcccagctcaatgggattaaaaaccacgacctatacttgtaggatttcaacttcactactgagcaacttttagattacaacccatgtaacctaggaattaactacttaatcccttattaacttgtaacacacctattacaagccactttataatactcctattacaaagacttcacaacatgactaactctagccacgacacagacactggagttatgatttaacaagagtttcctaatcaatgcttctagacaagctaagtaggaattacaattgaagaactattacatagttacaactctattaaggacatacagagacttgatatgggaactggtccgtagaagtgtcgtagtttgttcttgatgcactggagaatcgtttttgcttgataatcaatcacgtggagtgtttgagtaaattctctagtgttcaagtgatgttttgtgattggattaatgttattataacattgatgacatcacttgaatgatataagcactttatgatacaaggtcgttcctaatggaaatgacagttgcactgtgttgtactgtttgcgtgtgtagtgcagttaatcactttccagctgtggagagttgacttagtacagtcaccaggggaacctaagataatctgttccctgtgttgattctttaacttctaaagttctgacaactatctccagcttgagtcaggttgttttcatgcgcttgagaatgtataccaaaagtgaatcaggttccttatctggttcttgacaataagtttgttagatcatcaaaacataaaacgaatgtacttataacctatcaattttcccctttttgatgatgtcaaacttataattgaaaatattgcaaaagaaccattgtgcaccaggaacctcacagagttcccctgaaattgtattccccttaatcagtgcacatcattattcaatttatcttccctctttaggcatcattaaaagcacagaacaagtaaaaaagcataacgaagtctagcgtggttaactcatgccacttgtgtgcacacaacatgatagagaacggagacagatgagcaatagcacaaacaacaaaaggaaaagacttgcattaaccaaatttgaactgttacagcgggagcagaatcgttgttaccatccacaaaaataaaaaaaaaacaaaacaagtaccagaacaaacatcatcaaaacagacttaaaagagagacactggaaattggacactaaggggacatttcttaaggggaactggaggaagagggcttggaagaggcagcaagggttttgaggacaagatccatccgagcatttgcggacattggctcattgagcagtttctcctttaggtcctcaacctatttcctgagctcagcattttcctttgtcagtcgagcaacctctgaattagaagaactggtagaacctggtgccccctgtacctgactaagctgagtctctaaaatagcattcctagccttcaacttccttatctcctctgtagcactattctgggcattaatcagcagagggatagttgaggtgttgccgactcttccgaccttgtcgatgcattcatactcttccagggtggtcttggagaaggtctgcttcttggtccccaccttggcctgtcccacgggcatcttaaagaacttgaaaacctttgtgaagaggaacctgaaagggagcccaagttgccgtccttaaaatctgccacattttgcatgtgctcaatcatgattcctggcagattgatagtggtgaaactatccagggcttctataaggactaaatcggcatttgatgtgatagatctcctctcagcacggggaagaaatacctgttaatcatctcaaaaatcaactgataaactaggggtgcctttttgtgcacccgttccccatgctgaactgccctttccttgacaatggtattgctgaaatttgacgtgcaggcacccagaatggatgataatcccttagtgggaacttccagaatttgtcccaacacagcagaatccatcactatgtccacaccatttaccaaagcacaaatatgatcattttcaaccgtgaagaggtctgcatagaagttacgcacctcctcctcatatacctttggtacatcaactgtgaacatatgtttacactgctggaactcactgatttctaccaactttctcatcccagccatattcataatctcaggggcaaacgtgtggccccacaataccttttaatatcgcagcttctcttttccagaactctaaccaacttttgtctttttggaggaacagggttcctcatcatcatccaacttccttttcactgagttgcgactagactaacccttttctacagacattgtatgcataagctcacctgaaacttccatttcttcatcatccaacttgttactactcatattcactgacttgccaccgaactcttcacaggcttttcactggggtagcatcaatactcttagatggactctcaacacttttatacgtgtgcttgttagattgagagagaaaatggtaatgcttctgcctcaaagacttgcgagttaaggaactaggttcctcttcaggttcctcatccacagcaaccacaggaacatccttgtctagtataactttttcatctttgaccaactttctctttcttttactcctatggattttcttgagagcatattcgagagcctcctttttctgtaaccgtgtagtgggtctcttaggaggaggctccggggttgctactggctttctaaccctgataaaactactaatcaccatatcatctaggtcttctttactgtcagacttcatctcggcccaccaatatccaggagctcagcatagaagtaaggagaaggagcaggatcaacactaacctggggtaatgattccttacctggattctccggggaggatcaagtccatcatttagaaccccagtagcctcagcttgtgacggatgttcaaatggcacaagtgctccctcctcaactgtgggctaaggctcttccccctaaggcacatacctcctataacttcttctataaccaccctttcttgaggttccgtagaaatgcaacagagggagcagagatacttgtagaatcgcaacctgtcacggttgtctcagctttttgtggattgatcgttagggtttcactagagggctcttccatggtaagagacaatgttccctgtttttcctcgtgaactaagtcgccctgtttaccctgttcactttgctttaccgtagagaatggaagaagactagcattctcagacttgttcgactctttgtgactttgatgaggactagaatctgagtgggtagaagaaggagtagagtgtggagggattttgctctagggttatgactagagactgtgttgggtgaggaatctactgatggagttttaacaaatttggactcaatggggttaccatctggtacattaggggttatttgattttcagacatggtgagattttactggagaggctttgagagttgggaagagagaagacaaagaagaaatttgaatttggaagtgaagggttgtgaggttgatggatgtatttatgaaaatgtaagggtccggttctgaaatggcagcaaatttgcgtggggagttgggtcgttcactggcaggtgagacgttttgagtgaaaagacacgacgtaataagactaaaacgttgatgatgtggcatgttttttgtccattttaaattgtgtatgagagaacaaagaagctactaacctgtgtcgtgagaaccaggttccctaacaggtcttgcaagtgagcttaaccccttttaccagtatgtactgcatcaagtgctttgtaatcatcatgtgtgtctacctgtaatggtatagaagtgagttagacttggccagaaaatactttagctaattttacccgtttgtgactttcatagccacttactgggaaccagttcctcagttggcttttatcaaccccaatgccaagcgatttttctcaaaatgttctctactcagggctttggtgaagatgcctgcaatttgatcttcagcgctgcaaaacttcatacaaataagcccattttcaatgttgtccttgagagagtgatggcgtatcaatgtgcttggtcctcttgtgttggactagatatttggccatgttaagtgcacttgtattgttaaacaagataggttcacactcagtggaccccaaagtcttccagttgctgtttgattcatagcagttgagcacagcaagaagcaactgctacatattctgcttcaactgttgagagtgccactgagttttgcttccttgtaccccatgagataaggcaggaacccagaaaatgtgccattccagacgtgcttttttgtccaccaaataacctgcacaatcagcatctgcatacccaataagatcaaaattgtcacctgaaggatagtagagaaccaggtccagtgtttctttaagatatctcaaaattcttttagtagctttcagatgagattcctttggatttgattggaaccttgcacaaagacctacgctaaaaacaatgtctgctctacttgcaatgagatacatgagtgacctaatgatgcctctatacatggtttgatttataggagaaccaggttcatcaatgtcaagatacgtagttgtggcaacggaatgtctatcacttttgatgtttccatgtcaaatctttttagcagctccttgatatacttttgttggcttattaatgtaccctttgtggacttcttcacttgaagtcccaagaagaaattcaattctcccatcatactcatcttgattcactccccatagttttgcaaacttgtcacaaagagagttagttgtggctccaaaaatgatgtcatcaacatacaattgaatgatgagcaggttcctccctcgtttcttcagaaaaagagtgttgtcaattcttcctctagtaaaaccattttctcaaagaaactttgataatctttcataccaagctcgggaagcctgatttaacccatataatgctttttccagcttgaacacatgctcaggatactcgtgacactcaaatccaggaggctgcttgacataaacttcttctttgaggaaaccttttgggaatgcacttctgaaatccatttggaacaatgtgaattccatatgggatgcaaaggcaatagaattctgatagcctccattcgagcagctggagcaaatgtctcatcataatcaatctgttcttccttattgtagccttgaactacaatccttaccttatttcttgtagtatttccaaactcatcaagtttgttcctgaatacccacccagtcccatgatggtatgatctgtaggtcttggaaccaggtgtcataccttgtttctctcaaattgatgcagctcatcttgcatgattgtgatccagtttgcatctttcagtgcttctttgatatttttaggttcaatttgggaacgaaaggctgaaaaagcaagtgaatttctgacttttgatccggtttgaactcctaatcaagtggggtgattatgttgtcaagatgtgagcttttgacaacaaatctcatgaagcagtgaacaacttttaccataattgaaatcagacccaacttttcccacaaatcagcaaataatttcaacaaatcagaaatcaacgactatgatcgaaatcagacccaattttttccaacaaatcaaaaaatgatttcagcaaatcagaaagcaatgaacactatttgcttttcaatttcttgatcccaaaccgaacaatttcagtacatcaactgaaaataagtgcatcatatagatcatggaagtcaccaattacaacatatatagtctcggccacttatactagaaagtcaccgatgagtttatttttatgataatgggcatagagttttctctaatacgaagctttggagtgtgattgatagtaaaaaattaaaaaataaataaatatgtcggtttaatatggagctttggagtgtaatttatcaactttttttgttatggacttaatttggaataaaggaggaagagaggaaaaaggaagaaaaagagaaatggaggggggattacgggggtggcgataattaagggggtgggagggagaagagaacatgagtgaagaaaaggaatgagtaggggttaagggtacgaggaggaatgaatagaggtgaatcttttatttatttattttttattaaattttctcgtattcaccgcttcatatccgtgattaatactcaattgaccacattaaatataatattgccacataagcatagtcaacggtcaaaggtattcattaatagccattttttaagaaaagatgttcaaatgggaaacacaaaagtttatatatcggctttacaaagtggtgcaagtttaagtggtcaggaagccattcgcctaatttcaaataatagcaaaatttgcttcttaattacaaaatatctattaatcttgatcctaataatcaaactagtggaataaattatcaattctctataagcatgataatgtgatagcgaggattttcaaggtgcaacatattcattggagttaatatggatgatttattcatcaagtctctactgatgtcaatcttcaagaagctagtgcacaagattgagatgcgaaggctcaaggatgtgagttgatgctctcatcaggggaagttaatgcgcgttgtactctttttcccttacaaggttttgtcccactggattttccttgcaaggtttttaacgaggcaaccaaaaggcgtattctaaacatgtgtactctttttccttctctagagttttttcccattgggttttattttagttaaggttttaacaaggcacattatttgttgaatagacattcaagagggatgttataaatagaattctatttaatgtgaatgtctatattttagagagattttagggattttactttgtggctaagtcactctttccctataaatataggagtcctattctattgtaaatcatcccaaaattcaataagaatttcctctatctctttctctgcaatatggttcttcttcttttattgttttattacaggttgtttattgttcgatttgagtcgggaatatgaaaaaattaaacaagtaatttgctaaatgcgataaaataatcaaaccaaataccagtttaattttatcgatttcgattcaaaatggttcttttttctttaattcttctaacatcgaaggaatattttaatgaaatgctttttatacggaaaaattaaattaagaattaggtacttagatcgtctcctcttgatctatagtatgttgcttcgttattatgtttaacaaacttttatcgacattcacgtttatagtaaattaccaacatttggtaaatcttttttcggaaaaggttcaaatcatattatttgcttccccaatcaattatttcacaaaaatagaacatagaattaaaaaaagaaaaaaagaatgggcgtaaataattttctagctcttctcaacccataatttagtgtattttttatgtgaaaaatgaaaaagtaagagatatattttagtcttcctaaaaaagaggaaaggtttcttgagcgtttgaacataaattggttgatattttaaaaaaaagaatttgaagttaaattgaaaatgaaatagaaaaaatgacaaaatgctaaaacggtttaaatatattatatataaaaacagaaaagaaatttacgaaaaagtgatctaattttagcataatggaataaattctagttaactaagataaacatagcttaatacatcaggtgaggtttttgatgatatggttttttggtcaaaaaaggggcaagtgcacggatagtcattctcagagatgatatttagatataagccagtactttttgtcctgaaattttgattaaaaatctcaacttcaggataactcgggacatttttgtcctgaaaaaatgaaccgaaaaattaaaattcaggacgtgctgactaattcctaaatagcagccctttagagtggctacatggtgttatttctatcccaaagaatgtatttggccttcagataacttttgttgagtaaaagataaaaataacaaaatgcaattaaaattgttctttgactataattaatgaagttttcctttatcactttcaggtaaggaagaataatgaaggtaaaaaaaatataattaaaagttcatttattaaaagtaatctaaagaaaatatggataatagcatcactcaaaaaggatcataaatataaatatctaagattattgatttatcactacttttttttattaatattcatgatattcagatcaagattgcgcggcggtacttattatctcctatcgataaaatatcgaataattaagttcacaaaggattagacagatagaaaaaaatcatttaatgttttttgcatccaatgagattagactcatcactgcctcaactatataatgtagcaataacatgaatagctctacactcgttacaaaaacataggcaaaaagtttacaaaaatggccacttactcaatctcttttaacaacatttcttactttggctttgataattgttcccaattatggccattctagatctttaatccacattgaagattatagtcccccaagagcaagtcattgtcttagtaataatggtcaagaacaaaaagagagtgaagaattctatgtttgcccaccccatggacctgttaatgattttagcgcgccaaaacaaggggtagagatcaacgattacccccacgagaccagttcatggtcttggaattgatcacggtatagcaaaacaaaggcagagatcaacgattacccacctatgagaccggtgcatgatcttgcaattgattatggtgtggcaaaacaaggggcagagatcaacccatccacgagaccagtgcatggtcttgcaactgatcatggtgtgtcaaaacaaggtgcagagatcaacgattacccacccaggataccaatgcatgatcttgcaattgattatggtgtgacaaaacaaggaataaagatcaatgatgcaccaacgcaaggataaattaatcatcaattttggtaaatttttgaaaatgtatgtgcaatcatgattgtactgtgagaaattggtgaatttcagtttcaattaatagcaaaaaaattgcttaaaaaatgaatatcaagttatgttgtttatccttcacaatttgagtcaggattatgaagtcatcaaataagtaatttggtgaatacgtaaaaatgaatcaaccaaagattgaatcaaattagaacgttgtactttttatttaagaatgctcggtaatgacatgtgaacacatactataaatagaatcgctgtctctttctctctaaattttttgtttctcatttggtgtttggtatttgtattgggactcgattaaattcatatttacgttgtgaaattctatatttagagtagagcgcttcctaacaaaagaactccatactaggctcgaggccacttactacttaattacaacccttattggtctggatatctatttattttctgttcatcattctattattcagtttgatcactttggttgcttgtgcctagagctgtcagtatgggcggggccgagtagcccagtctagctaacgtgggcttagtaaccggcccagctcgccattttgatggaccttgtaatggtcaacccacaccagccctatgagggctgcagccccacgggtcgacccatcatcttttaaaatataattatatatataattttaattctaacctaaaaagataaatatttaaaagttaaaaaaaaatcatattggaaaatttttataaaacttaataattttttttactgttctaatatatcacagtaaacactaaaaagcaaaagacaagattatatctcattcgctgaaagtcaaaactcaaaacaaattattcaagagaacatccatgacgcttatggatatccaactcatcatctcattaaacacatttgaatctgcttgtcataaggttctattaacatctttactttcatctacattttgtgtcatatactttttatattttatatattttaaatacatatttttattaggccagggccgacccaggccaggctcagtcaagcctcacaagccacatgcttacttgggccgggcttaaaaactttgtttttaaatggctccaaaaactctagcccaaccctactaaatcatgagctgagctgtgtagacatgcaatttttgacactccccgaattttacacatgttagcgttcaaatatttagtttaggtctagtatcgcaaatttaactagttttgactctttactttattttatctcaaaaatgaaaataaaaaaatagtttcactttgttttcaagaatatcagtatttgggtagtaatattttttaatttattgatgattttagtctaatcctatttttttttagtatgatatttgaaaaatactaaaaatagttttgttttaacggttagtttatttaatagtcatttctacttaagtaggattaactaatatatgtgggtagtatttttttcttgtgtaatgagaaagaatcaaatttggcctaaaataatccaattttgagtcccattttcggtttagcccatagcccataccccataccccatttccctataaaaaaaaaacctaatttcactaaccctgaacaccctaagagagaaaaccctaggagagaatcctaaacaaaaagacaccttccttaccctagaaaagaagaacagtcgctgctcctcctcttgaagccgcatcggcgctgcgcaacaccggcaaaccagcgtccagcctctatcctcacacccaaaacccttacaaaacctaacaaccctaattcaaccaagactaagctgccgccaccgccaaactccccaccatcaatcgtcggccgccatcaactctacctatctccagccgccaccacaaagatcccccatcagtcgcactccacatgcacatatatgtagaagccgccgctcccacagcagccacacccaccttcaccatgctgccgctggacttcatcaccggcggccagccacccatctctttctccagttccagcccctacctagaaaaagaatccagctgtcgctccccctccaacctagagtagtcgcatcaccccaatccagctaccgtccaccatccaactcagccgcacttcagccctttctgtcatgagctcgccgaatcaatggcttataacaaaaacaaaatgactctcactctcactccccatttttcatagacgaatcttctctttttgctattagaaattcatttctctaatacactcacatacctacttagaactcacagtaaaaaaaagaatgaaaagaaaatagaatttcgaaagcggccttgtctagctcttttcagtgttgttttagcagtttagtaaacgagaaactgaggtttgaggtttcgtgccagtcaccgactcgagttcgtgtccgcggttcgtcacatctttgagttcaacatagtgaatcaatcaattttttgctatattgaggtccaattctttcatactctatccgttttattcaagcttaatgttaattttgtttggtgatgtgattccgttacttgtgtaattgttcttgatggttttgaatttgctcatttaattatctgctcgtgcttactcgaattggttatagttgaacatgattttaccatagtatagaaatttgtattcatcaactaaaccacatcaacttaagctaaagggttcgggtgctaaaatttgtgaaattgagctgttgattgtttattgctttgttactcgcctatattcgctaggagcatgcttaggccgatcacactcaggtaggcaaattttaggtttctgcttttatttgaggtagttggttgtccacgttgttgattttatatctggggaatgccccgaggaacttgtaaattatatattatccgggaatgccccgaagtactttgtaaatattctgggggccgtgacgaagttgcgagggaagtatatgtgtagaattttatttttattttctctttccttatatttgtctttatttaggtagggacaacctcgaacctttttacgtttgcttcttgtgtgttttctttttttcttttatctcaatttgaatattttaaaagccaactagatcgagtacgcaactgtgactttctcgggactcgggaatgcctaacaccttttccccgagttaaatgaaccctttacctagaactctggtgcaaactggtttaagagtcaaatgtacttttgaaaggaaatcattatttaaaaaaaaacggtgacgtggcacaccaaaatcaaatatcaggtggcgactctgaaaatccttttaaaacacaaatctttgtcactttataattgaaaaccttttgaactttacaaatcttcttattatttaatagagggtttagtgagttaaaaaaaggggtgtgacatctttagcgactctgctggggagttgcaggttcgagttgatacttggtcttgttggcttttaggatatttagttgaggtgtttgttttctttatttgctttgtttattttgtttgtttgtcttatttcctgttttgttggtattatttaaagtttttcttttatgtgttactactttataaatatcatcatttacataaccatgagccttctttttgcaacaagtctcgtagtacgcatcacgtacacgaacacttcattgagtcacccttattttaggagggggaggggggaggacgtatggagtgggtggaaggcttgagcagccactatcgatcatacgctccccccccccccccccaattgccttgtttgtgaaccccaaatataggccagcttttaggtcattattatttgcatcatatcatcatgacttagtagggttcggtcccaggtaacgtgttccttcgtaggaacctatccaaattgtgtcaagtgggcccatggtccaaaagaatattcaatcatccctatgcgatacatgatacattctttgacagtagaaaggtcatttagtggacttatgcttgggaaagaagggtgaaaaatgaagcaagtagggcccacttttatttttctttcacagcttttttttttaaaaaaaagacaaaaaaaataaaagtgaaaaatccaaaaagattttgcactttcccaccattttccaaaaaataaaaaaaaaagagaaaaagaaaatccaaaaagattttacatgtttcatatttttttttcaaaaaaagacaaaatatgttttctccaaatcaatgtctttttttttgaaaattctctcccatattcaatcttcccgaactacgcatacttgattctcgtctttcggggcggggtatgtaggcagcccacatagggtccgatcttcctcctccttctagtcttagattcttgtcttccagggtcgtagcaaaatattgcatgtttaacctcatttggtcacattggccgttttggcaaaatagggttagtttctcaaaatagtttgttatctcatgtcttagagatccaagtcccacaacaagtgtcttctcaattttaatgtctattcctattgaatttgcatgcctagccacttttggccacttacaaaatgggttattttcgcaaaagtgatttattgatccggtttaaaatcttgagtacacagctagggatccattcctaaggtccgtccttttagtttgcatctttagccacttctggccatattggctatttttgcaaaatggttcatttttgcagattaaattttgggccatgattattggaagtttgaatccatataagcctaaatgagacattttccatgtcttagaggtcaatcttgttgagtttgcacgtatagccacccttggccacataggtcattttgcaaaaataagctcaatcatgacttgtatctatcaaatacggggtgccatagtagtgtcgagtcactaaatctatcggtcctatttttctcattcaggtgtgaaatccaattaccagagctcggagcatgacagataccccaggaccattccatcgggactgttgcagacatgagttgcttaaggatacttttatgttttgagtcagttattcatgttgtcttttattttctagtcttgtacatagtattgagtcttttaggtgtgtcagagtctgtcatagtctagttgagttcgtcgagtctttgttatcatatttcctgtatttgtatgtgaaaacaaaaaaaaatatttataaagcaaaacccaaaggattttgctttagtttatttatccatcgcttttccagaattacacttgatctgattcatgtagaacatgatacgtaggcaacctacattgggttcgatcgaatcattgttaaaaaaagaagaagaaaaaagagaagttgtgggacgtgagggtgagagaaagaaaatagtgataatataacgaaagagaggaaggaaaatgagcaagccaagaagtgctagaaaagaaagaaagagaagattgaaatgaacaaaattgggatatgccaaaagaccttgtgacccttgaagtcattctagaaccgttaattgttgctaggtgcattgcacgcaatgtgatatttctatatgataaatgccctaatgctaacatgttggctttgttttgctcctctttggtactttaattgttatgataacagaaggtggttagtttgtggcgttctagcgagtcatctgtacaacataaggtcaaagagcaagacaatcatgactagcaaagaaatagacacaagagttgttgacctgccgaggaaaattgttgaatcagaatcggaactgaaacaggaggtccgaggttaaaatatcagatggcggaaatgtatcaagcatggattaagggacaccctccaccttcattccctacaaactatgcagaaaaccatgcttccattctaccactatccaagcccagatgcccaataccgttgaccttttcccacaacacgcaccaggcttcaccccttaccactcctacccccgcactttatcccaaacttttcatgctccaccagccaaaacaacctcataccctgctccgacatctgctcctatttttgtaccccctccacaagctatccttcaccgatcctctagtgagcctgcattctacgctccagatacccaatactatgctccggaacccaccttcaaagtcccagatccttactcctacactcctcactttgagcctcatgttgaaactgagaaaccacccaagaacgcagagcaagaggagatattcaggaaactaaagagtccggagcaatcattgagaaatatgcaagggttaggaagctaagtgagtgtggcttataagaatttgtgtttgttccctgatgtccaactgcctgccgggttcaagatgccaaagtttgatttatatgacggacatggggatccagtagcccatctgaggggttattgtagtgaaatgagaagagtttgcgggaaagataaattgttgatggcgtattttagtgagagtttgggtggggaagccttggagtggtattctcgtcaagaggtcagtaagtggcatgcatggcgtgacatgactcaagattttgttcggcactatcagtacaatatagacattatcccagaccactcctccatatctcagatggaaaagaaacctaaggaaagttttagggagttttggttcagatggaacgaacaagttgctcgggtcagtcctctgattgatagaaaagatgttgctgagccccgccaacgacaggatctagtgggcatccctgctaaacgctttcagcctcaataccaacaccatgaatatcccgagctccacataatccaccacagtattatcctctgaacaacgttaggccatttgtccaaccactgggtcactccctagggtgagcaccagcatcccaaaattctcgtgcgccttcacaacattttcaggcaccctataaccctaaaaaatataggcatggagggaaacaaagatagcaagataagtttcacaccaatatggaaatcctacacaaacttgtttgaaaggctaaaatattctagcttgattgagtcgctcctcggctatactccagacccatacgcaaaaggttttgatcctactgtacggtgcatgtaccactctaatgtccaagggaatagcattgaagattgtcgtgctttgaaaagagagatcgaaagaattatccgagaagggttaattgtagtccaaggcagtaataccccaggtgccacacataatcctctataggtacatgactacgcataaattgttgggatggtttgcaattaaaacgaatgtgcttcaagtcctttggtaagtcatttgcggcaagatcttttagggggtcagtggctaattcaacagttagtgctgaagaggggttgttcaaaggagtcaatgagccacgtagtgaagacaatgtggttgaagttggtgaaggtcccagtaattttgatgtgcaactcagtggctaagatctcgagtttgataattagaaagcaccttatttccttatcgggaaggagtcttggcagttcattttgacatcttttctgctatctggttatttcaggattgtagcccagattttatcttgtttgttctggcgattcaaacctttctaacctcttttgcctatctctaggagtcttgttagttagttttgcgtctctaaatctgtcatctagggttgttttagggctttaatatagattttattctgctgttcaaacccttccatcctttggtcaaatgagattttgtttttctgttatttgcagtcttcgtttagttattttgtatatagttctttttagaccagttctagtggcatgacatgcatgcagagcttttagccagatcttgaaagccaatctaatcatggaataatgaaacatagttttgaatatgataaaaagatgcatttgaggaaacaagtaaatattcacacattctgagataacccgaagcttgaattgagtgaaattgaggcaatttgtgacgacccgacaggtcgttttgagtatctgcacttcgctcgccattttgagggttcgagtatctctatgttatgttatgggacttattggtatgtttggacgtggtcccgaggggttcggttgagtttcagataggtttgggctgcgttgcgctcgtttttcttatgtttcgacgtcgtttcttcaagtataaatggtaccacactaagaaaacgagatccgatctctattttaattgaagcattagatccttatcataattacggagccatagcaaaaagaatcatcgaatttgaacatcgtatgaggaatttatggtcattttaataaaaattgggttgctagatttttcagtttaattacgaaattactactaaattcatattaaaaaatctacactatttgcaaatatgaaaccaacatatctcctttattataaggttaaattgagtgattcaaaagcctaacttgacaaaaatttcataaggtatccattggaggcataacaagcgagtttcattattgtttggcatgagaaacgaggcagaatagctggcagaaaaaaaaaataaaacaagggtttgttcatttggtcatattttgagttggggggctcgaatttgtgcgattttggaggcgattttcaccatatggattgggatgagtgttctctactcggttttggttatatttcatgaatccatcttcttttttgggatttgattgatgatttcaaagtgaaatttgaggggttttccctaaagtttcataatatgaatttttgaggtttgaacatcgatttggagtcagaattgagtgaaactagtatggttggactcgttattaaatgggttgtcggattttatgagttttatcgggtttcgaggcgtggtttcgggtgcgatttttggccggatttgggatttgatttaggattcgatctttatcatttgaaattgttttcttgtgctttatttgatgtatttgagttgcttttggctagttttgagacgttcgaaggtcactacgcgcgtgatggcatttttggagcatcgcttggcttgctcgatattgtaattgacttgttcgaagtaagtgttttgcctagctttgttaagagaatttttcctcctacttgttattgttttctacatgtgggggtgatacatatatgaggtgacgagcgtatatgtatatgccggtgttaaccatgctcggggtagattgtgctataattatgttttgtagaatttgtaacttccttgcttcatgccttacctattttactgatattaggaacgtagtataaaatattagtaatcaagacttagcctaatataacttgatcaaatttgataaatttttttgaatacattgatgtgtctagttgtattcatctctatgcgtaatcactgctaccttgctacggttgatatttgaagtgctggattctattcttgtattgctcataaaatatgaaatttgtggaagtacttgaattgtacgacccttgagggcttattgaatcattattggcttagaaattccgtgattgagaatatgttggaatattcgttgaacactcttctcgatattatttatacttcctgcattgccattttattgatattcatatgcttggtgaggaagagtgtaaagcacgaagggtgataccgtgtcattttttatattcattataatgtgaggaagagtataaagcacgaagggtgatgtcgtgccattgttatattcattatgtgaggaagagtgtaaagcacgaagggtgatgtcattccatttttatatcattatcatgtgaggaagagtgtatagtacgaagggtgatgtcgtgccatttttatattcattatcatgtgaggaagagtgtaaagcatgaagggtgatgccatgccattgtttatatcattatcatgtgaggaagattgtaaagcacgaagggtgatgccgtgccatttcatatacattatcatgtgaggaagagtgtaaaacacgaagggtgatgtcgtgccatttcatatacattatcatgtatggaagagtgtaaaacacgaagggtgatgccgtgccatttaatatacattatcatgtaaggaaagagtgtaaagcacgaagggtgatgccgtgccatttcatttatattattatgcctttaatattgtgaggtcatggcacgaagggtgtttccgtgcaggtgaggatgagggcatgcattataatgtgatatctattttccgtgcatacatttccgcctttaccttgagttgttattgtcgccattatatattttgagtgatatgttgttattgtcccgtacttgacctctatctcaattgttgttgtgttatccatgtcttttaccttcttaacttgcatatgtcatgcctatttccttattttatactcatattgtatctattttgtcgcaccttagtgtaagccttccatcatgttagtccttcatgtccttactttttaatttgttaagatcatgtgtttccttctttttttctatatttatccttaggcttccatcatgctagttaattggaattataacccctttttcttcctaattgtggtcgttacctctgtcctctctgcttagtctgttactgatgttcttctgtacattctcgattaccattactgcttgcatatttcccttccttgtcatttcaattattggtatttctattcattggttggtactgttttacacatttatggtgaggatgagataaatgcacgaaaggtgttgccgtgccgctagacttgatgtcttgagtactttatcacactatgaaagcatatgaggtgattgttgtggttcatgggcttcattctaaggaaagggccggttgagatgtctgaaactgttaaactgtgatttttctgatactcttttatttcctgtcacagtcgcattgtgtactctattctattattatgtctcttagttctagttctagtttacattatagtgttcattaatgagtatcttttaactaaatatctcgtcactacttcgatggatttagtcaagatacttaccagtacatggggtcagttgtactgatactgaacttctgcacactctttgcagactgttgaagcagagctgctgaagaagtcgggagctgactctgaagacgttcatgtattctggataaaagctgccacttatccttggtagtgttggacattagtaatctattcatgtagttttcaaacagaatgtgtatttattcataacaactttgtacattctaaatcttagaagctcatgagtcatactactagttttttgaaaaatttgtaaaagttcagataaatcctaattaaattttctataagtttatatggtgtttttcttttgtcaattggcttacctagcgggccaagttaggtgccatcatgatctgagatttttgggtcgtgacaagttggtattagagcactaggtttgtaggttctacgagtcatgagcaagtgtctagtagagtcctacggatcggtatgatgacgtccatatctatcttcgggaggctacaggacatttaggaaaatttcccttccatctttccttatcgtgccgccttgttttagcttgaaacctatgactttgactcttcccaatcgttcatatgtggtgttgtgcactcagtattcgttatgtgccgacgatcggtgttgctgcagatagattataatgtgttgtctagcctcagaagcagatgcagtgttaaatcttctagtcgttcatttgtggtatgaggcgggttcatatttctggttggtaagcatagatttgggaaattgactggtggcctggctattgtgactaaggtgggttcatggcaaggtgtcgatttgagtataccggtgggccatctcctgcatgatgagtttggatcgtgtgtctcgtgtgaggtttctatttggtggagtgcatatgtaattattttagagcatttggggaagttgtttgactattgtaatgatgggtaagcgcttggcagagtcttcggggcgttctatgaccagtattgcatgagtttttgaagtattcagctaaatagtcaagcgggatcggggaattttttgaagatatggtaccttgggttggtgatggggttttctatggcttcgagctaagtggtgaagtatgctaaagacgatcggattgtagggtcataggccatatcaatttctgaactgggagattgcttggttatttctttgaataggcatatgctggtgtagcacgggttgcttgacgcgtattagctgtgtatcgaagatcagagtaagatgagtggttaccgagaaggttctggaacgttccaggtcttatgtagcctttaagggcttttggatttgtctacgggtgggcttggaaatggaagtgaatggtaattggatctactgtgtttccttgtcaagaagagtccacatgtcaatgttgaagtgatgcaacaaatggtttcgaaatcccaagaagttttagggccgtcatatcggattgagttacttttaggttggcagtccgcgtgactcgattgagttagacgcgagtggttctgattacttgattatgtgttactgagtttcgaagaacttatcatggtcatgaccatagttggagttgatgttttctataggcataagagctataatgcttatgggtcagcgttgactgcgagactttcgtagtgttgcaaattagcatgttagaagtgatgcgccgagtgggattggaaggttgcagttagttttgaacggaaggatatgagttcttgatggtacgggtgattttcggtgtttaaggtcttgttggcactatgtgttttcaccggagcacctgtcgacagatacactgtgttttgatttatgggtacattccccaaggatgatgtatactgaattatgtgttagttatttgggaagcggtgttgagattgggtatgaaaattctggtattcgcgagtcttagaggttgaatggttttggtggccgactattccttgactgcgagatgggaagaagtgtagaggattggaagatttggaaggtttattacatgtttgaggagatcgaaatttgggtggaaattatttttagcctaatgataatgtgtattccgtatcagactggatttacttgctcttccgcagttgttgccacatgtatttcatcgggaaaaatggatgttattcatgcctcggtttatgtcgtatctttctcttctatgctatgacgggttgtatggttacatgattcttcgcacgcatattttgatttagaataggactcctagaattatgggcgagatggcctttgtgatgttgatttgctcattgcaccatagttgtgcttggctttctcagtattgtttgtccctttcaccacagttatatttttgtgcactcggttgtgcttgatattgacgcacatgtgatcagtgagcccgagtattatggctcgaggggtaccctatatggattgatatgataggatcgggttgcacgccgcaatggtacagtgattaaatatggctccttatttctatttcgtgtattttgctttcaccttgttgagaatagttcatagtaaaatgccaatttccctgcctgcttaacttgcttagtagttttcttactgttatctgtctatctgaattattacttgtagtgtacggaaccggggttgtgtgtggctccatatattttgttaatgcttgtcggtggcgactgctcgtattggctgagataaggtttctagacctgagatttgcgctattgtattgggatgaggaaggtttggaagaataacactatactttgttgaggatgtggacaatggccctgatcgggtgagtgagttcttggcttattgatcagatgagtggttaagcggttatgcgtgtttctttcattatctgtagggtatgaaggttttgaacgagattctaatcggtatgaggtttgctaccagcaccggatttgttttgggcagtaataatagtcggcagttcctactgtgagtgtcgaagtaatggggtatatcatgtgattacatcttgtgttatggttgtgacttgatacagcttgttcagcttataacagtatgtggctatggactggggtcttataatgaattctggatgatagaaattgagttctaaggtttaaggaccaaggtccaaataaggatctctaattatgttgtgttagaaggcttatgttgatcagggtgacgtgggatcacccccgactttatgcttagtaaggttacacgtgatttggtagctttggaaagactcctggcacgttcgaggacaaacgtgtgtttaagtggtggaggatatgacgacccgacaggtcgttttgagtatttgcacttcgctcggtattttgagggctcgagtatctccatgttatgttatgggacttgttggtatgtttggacgtggtcccaaggggctcaggtgagtttcaaataggtttgagctgcgttgcgctcgattttctgatgtttcgacatagtttcttcaagcataaatggtaccatattaagcaaacaagctctgatctctgttttgattgaagcattagatctgtatcgtaattaccggccatagcaaaaagaatcgtcgaattggacatcgtatgaggaatttatggtcatttcactaaaaattgggttgctagatttttcagattaattacgaaattgctactgaattagtattcaaaaatctacactatttgcaaatattgaaaccaacatatctccttcattataaggtcaaattgagtgattcaaaagcctaacttgacaaaaatttcataaggaatccattggaggcataacaagtgagtttcgttattgtttggcatgagaaacgaggcagaatagctggcagaaaaaaatataaaacaagggtttgttcattcggtcatattttgagtagggggcttggatttgggcgattttggaggcgattttcaccatatggattggggtgagtgttctctactcggttttgattatattttatgaatccatcttcgtttttgggatttgattaatgatttcaaagtgaaatttgaggggttttgcctaaagtttcataatatgaatttttgagttttgaacatcgatttggagtcggaattgagtgaaactagtatgaatggactcgttattaattgagttactggattttgtgaggttcatcgggtttcgaagcatggatccgggtgtgatttttggccgaatttgaaatttgatttaggattcgatctttatcatttggaattgtttccttgtgctttatttgatgtatttgagttgcttttggctagttttgagacgttcggcggtcactacacacatgatggaatttttggagcatcgcttggcttgctcggtattgtaattgacttgttcgagataagtgttttgcctagctttgttgagggaatttttcctcctacttgtcattgtttgctacttgcgggggtgatacatatatgaggtgacgagcgtatatgtatgtgccggggttaaccatgctcggggtagattgtgatataattgtgttttgtagaatttcgtaatttccctgattcacgccttacctattttaccgatattaagaacgtagtataaaatgttagtaatcaagacttagcctaatataacttgatcaaatttgataaaatttttagaatacattgatgtgtctagttttgttcatctctatgtatattcactattacctcgctacggttgatatttgaagtgctggattctacacttgtgttacccataaaatgtgaaatttatggaagtacctgaattgtacgacccttgaggacttattgaatcactactggattagaaatttcgtgattgagaatatgttggaatatcgttgagcactcttgtcgatgttatttatactttttgccttgccattttattgatattcatatgcttggtgaagaagagtgtaaagcatgaagggtgatgtcatgccattttttatattcattatcatgtgatgaagagtgtttagcacgaagggtgatgccgtgccattgttatattcattatgtgaggaagagtttaaagcacaaagggtgatgcccttctattttttatatcattatcatgtgaggaagagtgtatagtatgtagggtgatgccatgccattgttatattcattatcatgtgaggaagagtgtaaagcacaaagggtgatgccatgtcattgtttatattatatcatgtgaggaagagtgtaaggcacaaagggtgatgccgtaccatttcataaacattattatgtgaggaagagtgtaaagcacgaagggtgatgtcgttgtcgtgccatttcatatatattatcatgcgaggaagagtgtaaagcacgaaggataatgccgtgctattctatacattatcatgtgaggaaagagtgtaaagcacgaaggatgatgtgccatttcatttatattgttatacctttaatattgtgaggtcatggcacgaagggtgtttctgtgtaggtgaggatgagggacatgcattatgatgtgatatctattttccgtgcatacatttccgcctttacctttagttatcattgtcgccattatatattttgtgtgatatattgttattgtcccgtacttgacctctatatcaattgttgttgtgttgtccatgtattttacttgcttaacttgcatatgccgtgcctatttcctgcttttataattatactcatgctgtatctattttgtcgcaccttagtgtaagccttccatcatgttagtccttcatgtccttacttgttagtttgtgaagatcatttgtttccttcttgtttgctatatttgtacttaggcttccatcatgctagttaattggaattataaccccttttttcctaattgtggtctttacctctatactctctgcttagtctgttactgatgttcttctgtacattctcggtatttctgtcatttggttggtactgttttacacatttatggcgaggatgagataaatgcacaaagggtgttgcctgccgctagacttgatgtctcgagtactttatcacacattgaaagcatatgaggtgattttgtggcggcttcgttctaagaaaaggaccgggtgagatgttgtgttaaattgtgattctttctgatactcttttatttcctgtcacagtcgcattgtgtactctatttctattattctgccttttagttctattgctagtttacattatagtgctcattaatgagtatcttttaacaaaaaatatcatcactacttcgatggagttagtccagatacttaccagtacatggggtcggttacacttatactgcacttttgcacactctgtgcagactgttgaagcggagctgctgaagaagtcaggagctgactctgaagacgttcttgtattctggatagaagcttccacttgtccttggtagtgttagacattattaatatgttcttgtagttttcaaacagaatgtatatttattcataccagctttatatattctaagtcttagaagctcatgagtcatactaccagttcttgggaaaatttggaaaagttcagataaatcctaatcaaattttctataagtttatgtggttgttttcttttgtcaattggcttacctagcgggtcaagttatgtgccatcatgacctgatatttttgggtcatgacacaattaatgtaggaaatcaagaggttaataagagcatacaacaaggaacgtctctcaaatagttttaggtagataaatcagtgttgaaatgcattcttccacatcaaggtaaggttgagtcaagtctgcttcgaactggcaaggatcattcagtgggacaaaggtattgcctatcagcactttttgtttgtgttgattccatcaatagatactatgtatgatttgtttgcttatcttcaattgcatgtttgtacttggcatttttaaagttcgttatgacgaaggcattttattctgctacccaaacactttcatcctttgctaaccccttttaagccttattcattttctttcatacccctcttttgtaatcaggagtaggattaaaaaaacaaagaaataaaagaaaaagaaaaagaaaaagaataaaaagaaaggaaagaaagaaaaaaagaggaaaaatcgaaagaaaaagaaaaagaaaagaaaaaaaggagaaaaaaaaaggcaacaaaacaaataacttttgcttgaactacgttcgacctgattctctttaaggatacgtaggcagccttactctgaggttcggtcccatcaaagaaaaaataaaataaaaataaaaagattcctagactccaaaacactggggcagaagttttaattttggctaaaagatctaattccaaaagttgtaattttgaatctttcatcttaaattattttgagccttcaggccaccatttctttctaaccctatccaaaagcttacatgacggtcgaaagaaagaccttccgactaatctttgaggatgccaaatcaagtgtgtggtgaaagtatgatcttcctgcatcatgggtaatactttgttcttagcaaaaagagagaacatgaaaaaatgagagtcttttcggtgaaaacccacatgggcaccgtaaggcgatggtgagctgagagaaaatataaaatgagagagtcttattaatgaaaacccccaccgggcaccgtaaggcgacagtgagttgagagatgagcaaatgagagaggcttgatggtgaaaaccattcggggcactacaagtcgaatgaggttcgtgactttacaaaaatttggatcatcgaaagccgattttgaagtatgaagacatgacatgaaccgaaagtgtgattagttggacgaattaggctgatcaatctgaaatgcaagtcatgatcattagagccagctgtttcactcagataagtctcttttccgttctttttcaaatagttatctttgttcgaaattccccttttattcctaattgtcaaagtcatttggatttgtttcttttgggtctatttttctgagtctctatcgaattagtctttgttaaacaagcaaaaagggattttaaagcctactaccagcttttgattgcataaggtaaagttggccaagaacatcgcaagtgacatgattcagaagggcaacgttaataactaagttcagatgatcaagcgtttcttgaatgttgagaaaatgcaaaggttcaacaattatcagtatgaaaacacaattcaacaagtgagtgtaaggattcaggtcattcaggggtttcggtggtcaaggttcagtcagaaaatcaaacaattcttctttagcccgaagcagctaatcagaacgaagcatgacagtggcagaagaggacacttccagcaacgatgccacaaactaaccaccacattttcaaactaacaagattccatttgtttgaaataggggcaagaaacttgttcgacctgcaggaccctccgtgaacaaagtatggtacatgggcatggaatttcgttctttctgcaaggatcttccaggaagagagcacggctcaggtaagttcatttccagttttcaccctcctggataatgggatttagttttcaagttttcaggaccctcctggataatgggatttattttctagttttcaggaccctcctggataatgggattaagttttcaagttctcaggaccctcttagataataggatttgatttaagttttcaggacctcctggataatgggatttgatttaagtttttaggaccttcctggaaaatgggattcaactaacactcaccaattttcctggtacaaactggggcagaaattttctttgttttgtctgttttgctgtgatcgcgggcgcccacctggagaacgagggaatttaatttcaagttttaagtgaatgctaggcgcccacctggaaaatgagggaattattttcagagttattccaaatttcaagttagtcgcaggcgacccctggagaacaaggaatttcatttcaagtttcaagttggtcgcaggcgccaacctgtagaatgagggagtttatttcaagttttaagtaagttgcaggcgcccacctggaaaatgaaggaatttatttcaagttaagttattaggcgcccacctggagaacgaggaaatttatttcaagttaagtcatcatgcgcccacctggagaacgagggaatttatttcaaatttttaaggcagcatcaggtgcccacctggagaatgagggaatttatttcaagttaagtcatcaagcgtccaactggagaaccagggaatttatttcaaagttttaaggcagcatcaggcgcccacctggagaacgagggaatttatttcaagttaagtcatcaggcggccacctggagaacgagggagtttatttcaaagttttaaggcagcatcaggcgcccacctgaagaacgagggaatttatttcaagttaagtcatcaaacgcccacctggagaacgagggaatttatttcaagttaagtcatcaggcgcccacctggagagcgagggaatttatttcaaagttttaaggcagtatcaggcgctcacctggagaacgagggcatttatttcaagttaagtcattaggcgcccacttggagaatgatggaatttattttgaagttttaaggcagcatcaggcgcgcacctagagaacgagggaatttatttcaaagttttaaggtagcattaggcgtccacctggagaacgagggaatttatttcaagtcttaagtcagtagcaggcgcccccctggagaacgagggaagtcatttcaaaattcaattcaagttagaagtagtagaagctcgcggcaagaatgcgagtcgacagtccgagaagaccaacagaagtagtctgaatctagaataaaagaaaagaagaagaagaagtgaatccaaaatgcagaagcggagaaagatgcaaactgctcaagacatagctgaagtcacgagcacggtgtatcctattttgctccgaagaagccgtggaagaatgaagcatcacctgcagctagcaagcattaggttcaaatctaaagtctacatgaagaaccattcaagactcaagatcaagattcagaagacttatatataggaatattgtaactcatagctgacagacttagttagtcttttcatttttgattttgatgtaataacaggaccgcggaccggaacctcgacggcacctcaatcgactctccaccttggtatactccttctttcttctcacttatgaattgtacgtggcctgattcctttatagccaaggatatgtaggcagctaagataccagggctcggtcacattctcctttcttttagtttttggtctcttctaaataaggatcgggtcaaaaaatctgtctcgttgttatttttttttaaaactctttgtatttccaatcaaaaaggggcagctgtagacatgtaattgttgaccctccccgagattttacacatgttagcattcaaatatttagtttaggtctaatatcgttattttaaatagttttgactcttttactttattttatcacaaaataaaaatacaaaaatagtttcacttttttttcaagaatatcagtatttgggtagtaatattattttaattttgcgatgatttttagtctaatcctatttttttagtatgatatttgaaaaataccaaaaatagttttattttaacggttagttttattttgaggcctcgagtatctccgtgtgatgttatggacttgctggtatatttggacgtggtctcgatggcctccagtgagtttcagataggtttgagttgcgttgcgctcatttttttatgtttctacgtcgtttgtttcaagcatgaatggtaccacattaagcagacgatctccgatttctattttgattgaagcattagatccgtatcataattacagatccataataaaaagaatagccgaattggacatcgtatgagaagtttatggtcattttactagaaattgggttgcccagattttttttatattaattatgaaattgccactgaattcgtatttaaaaatctacactatttgcaaatatttgaaaccaacatatctccttcataataaggtcaaattgagtgattcaaaagcctaacttgactaaaagttcacaaggaatccattggaagcataaaagtgaatttcgggatcgttggcatgagaaacgaggaagaatagctggcagaaaatatataaaataagggtttgttcattaggacatattttgagttggggagctcggattagagtgattttggaggcgattttcaccatatggattggggtaaatgttttctactcgattttggttacttttcatgaatccatcttcatttttgggatttgattgatgatttcaatgtgaaatttgagggtttttgcctaaagttttataatatgaatttttgagttttgaacatcgatttggagtcagaattgagtgaaactagtatgattggacccgcaattgaatgggttgtcggattttgtgagttttatcgggttccgaagcgtgggcccaggtgtgatttttcgccggatttggaatttgatgtaggatttgatctttatcatttggttatttccttgggctttatttgatgtatttgagttgcttttagctatttttgagacgttcagaggtcactacgcgcgtgatggcatttttggagcatcggttggcttgctcggtattgtaattgacttgtttcgaggtaagtgttttgcctaactttgttgagggaatttttcctcttatttgtcattgttttctactgcggggagatacacatatgaggtgacaatcgtatatgtatgtgccaggattaatcatgcttgggggtggattatgttatatttgtgtttgtagaatttcacgacctcttgcttcatgcctcacttgacttctagatattaagaacctagtattaaatgttggaatctagacttagcatattataatttgatcaaatttgatggaactatgagaatacattgacaccttacctattttaccgatattaagaacgaatataaaatgttagtctcaagacttagctatataacctgatcaaatttgataaaatttttagaatacattgatgtgtcgaattcggtcatccctatgcataatggttaatacattgttacggctgatattttgagatactagattccataactgtactgttgataaattgtgggatttgtggaagtacttgaattatgtgttccttgagggttcattaaatcattgttggcagtgattgatattcatatgcttggtaaggaagagtgtaaagcacgaagagtgatgccgtgccatttcatatacattatcatgtgaggagagtgtaaagcacgaagggtgatgccgtgccattgtttatattcattatcatgtgagcaagagtgtaaagcacgaagggtaatgccgtgccattgtttatatcattatcatttgagaaagagtgtaaagcatgaagggtgatgccgtgccatttcatatcattatcaagtgagaaagagtgtaaagcacgaagggtgatgcgtgtcattcatatacattatcatatgaggaaagagtataaagcaaagggtgatgccgtgccatttcattatattgttatgcttttaatatcgtgaggtcatggcacgaagggtgtttccgtgcatgtgaggatgagggacatgcattatgatgtgatatctattttccgtgtatatgtttccgcctttaccttgagttgtcattgtcgccattacatattttgtgtgaaatgttgttattgtcgcgtacttgacctttatctcaatagttgttgtgttgtccatacctttttcttgttaacttgcatatgccatggctatttcctgcttttataattatattcatgttgtatctattctgttgaccttagcgtaattcctcctccatgctagtccttcatgtccttattgttaacttgtgaagatcatgtgtttccttcttattttctatatttgtacttaggcctccatcatgctagttaatggaaattataacccttttttttctaattgtggtcattacctcagtgctctctgcttagtttgttcgtgatgttcttttgtacattctcgtttattattgctgcttacatattcctttccttgtcatttctattgtcggtatttctatcatttggttggtactgttttacgcatatatggtgaggatgagataaatgcatgaagggtgttgccgtgcgttagacttgatgtcttgagtactttatcacactatgaaagtatatgggtgattgttgtggttcatgggctttcgttttaaggaaaggccggttgagatgttggaaactgttaattgtgaatctttctgatactcgtttatttcctgttgcagtcgcatggtgtactctattctattattatgtattttggttctattgatagtttacgttatagtgtttattaatgagtatcttttaactaaaaatctcgtcactacttcaacggagttagttaagatacttacccgtacatggggtcggttgtactgatactgcacttctgcacactctgtgcagactattggagcggagctgctgaagaagttgagggatgaccctgaagatgttcgtgtattctgtatagaagctgccacttgtccttggtagttttagacattattaatctattcatgtagttttcaaacagaacgtgtagaaaattcatactagctttatatattctaagtcttagaagctcatgattcgtactatcagatcttggataaatttgtaaatgttctgataaatcctaatttgattttcgataagtttatttgggtgtttcttttattaattagcttacctagcggatcaacttaagtgccatcatgacctgcaattttgggtcgtgacaggtggtatcagagcactaggtttgtaggttctacgagtcatgagcaagtgtctagtagagtcttgcggattggtatgatgacgtccatatctatcttcgggaggctacagggcatttaggaaaaatttccctttcttccttccttatattgcgaccttgtttcatcttgaaacctacgactctaactcctcccaatcattcatatatggtgttgtgcactcagtattcgctatgtgccgacggtcggtgatgctgcagagattacgacgggctatggatacttgattattatcgatgtgttgtctagcctcataaacggatacagtgttagatcttctagtcattcatttgtggtttgaggcgcgggttcatatggctgattggtaagtgcaagtttgggaagattggctggtggcctggccattgtgattaaggtaagttcatagcaaggtgtcgatttgagtataaccagtaggctatctcatgcttgatgagtttagatcgtgtgtctcgtatgacgtttccatttggtggagtgtataagtgatcatttcagagcatttggggaagtgtttgatcactgcaatggtacgtaatcgcttaacagagtcttcggggtgttctatgattagcattgcatgagttttgaagtattcagctaaatagtattacgagatcgggccgtgctatgaagatatggtactttggggtaccgatgaggtgatctatggcttcgatctaagtggtggagtctgttaatgacgatcgaaatgtagggtcataggctgtatcaattttcggaccaggagattacttggttatttctttaaatgggcatgtgctggtgtagaacgggttgcttgatgcatattggctatgtattgaagatcagagtaagatgagtagttatcgagaaggttccgggagttccgaatcttatatttttgaatttgtttacgggtgggcttgaaatggaagtgaacggtaattggatttgcagtgtttccttatcaagaagagtctacatggaaatgttggagtgatgcaagaaatggttttggaatcccaagaagttccctcagggcggtcatatcggattgagttactttcgggttggtagtctgcataactcggttgagtttgaggcgattggttctgattacttgataatgtgttactgagttccgaagaacttatcatggttatgaccacggtcggggttgatgttttctatagttataggagctacaatgcttatggtgcagagtcgattgtgagactttcgtagtgctgcaaattagcatgtcaaaagcgatgcgccgcgtggggttgaaaggttgcatgtaaaaggttgcagtttagttttggagggaaggatacgagttcttgatgtctcggacaaattcaggtgtttgaagtcttgttggcactatgggattcccatcgaagtagagttcgccagttggcaggaacattgtgattcgacttatgggtgtttctccgtgagatgatggagaatgaattacgtgtcaacaatttgagaagcggtgttgagattgggtatgaaaattctagtatttgtgagactcaaagactgaatgtacttattggcagaccattccctgattgcgagttgtgaaggagtgtagaagattggatgattaatggtaggtgttatggtaaggttgctatagacttttggaaggtttattacatgtttgaggatgactggaatttggtttggggattattttaagcccagtgagggtatgtattctgtattaggttggatttgcttgttcttgcgcagttgatgccacatgtatatgatcgggcagagtggatgttatttgcactttggtttatgtcgtatgtttctctcttatgctatgacaagttatgagggttacgtgattcttcgcatgcatattgtggttcagtttaggcctcatggcactaaaagcaaggtggcctttgtgatgttgatttgtttattgcaccatagttttgcttgactttctcggtattgtttgttcctaatgatttttcccacaattatattttgtacactctgttgtgcttgatgtggcgcatatgtgatcagtgagcccgagcattatggctcgaagggtaccctatatggtttgatatgatgggatcgggttatacgccgcaacggtatagtgattaaatgtggctccttatttctatttcgtgtattttgctttcaccttgttgagaatagtttatagtaaaatgctaaaatctcccttcctgcttaacttgcttagtagttttcttatttagttttcttactgctatctgtcatatctgaattattacttggtagtgtatgaaaccgggttgcgtgtggctcaatatgtttatcgttgatgcttgtcggtgcggctgctcgtattggctgagatgaggtttctagacctgagatttgcgctattgtattgggatgaggaaggtttggaagaataacactacattttgttgaggatgcggacaatgggcctggtcgggcgagtgagtttcttggcttattgatcagatgagtggttaagtggttgtgcgtgtttctttcatcatcggtagggtatgaatgttttgaatgaggttctaatcggtatgaggtttgctaccggccccggatttgttttaggcagtaatgatggtcggcaattcctactgtgagtgtcgaagtaatggggtatatcatgtgattacattttgtgttatgtttgtgacttgatacagcttgttaaaacataaacattatgtggctgtgggattcggatcttgtaatgaattctggatgataaataaggatctctagttatgttgtgttggaaggcttatgtggatcaggctgacatgggatcaccccggggtttatgctttagtaaggttacaccatgatttggtagcgttggaaagactcatggcgtgttcgaggacgaatgtgtttaagtggtagaggatgtgaagactcgataggtggttttgagtatctacacttcgctcggtattttgagggctcgagtatctctgtgttatgttatgggacttgctggtatgtttggacgtggtcccgaggggctcctgtgaggtttagataggtttgggttgcgttgctctcgtttgttttatgcttcgacgtcgtttcttcaagcataaatggtaccacattaagcaaacgagctccgatttttgttttaattgaatcaatagatccgtatcacaatcacggagccatagcaaaaagaatcatagaatttgaacatcatatatggaatttatgatcattttactaaaaattgggttgctagatttttcagattaattacgaaattgccactgaattcgtattcaaaactttgcactatttgcacatactcaaactaacatatctccttcattataaggtcaaattgagtgattcaaaagcctaacttgattaaaatttcacaaggaatccattggaggaataaaaagcaaagttttgggaatgtttgacataagaaacaaggcagaataactggcagaaaatatataaaataagggtttgttcattcggtcatattttgagttgggaagctcggattagagcgattttggaggcgattttcaccatatggattggggtaaatgttttctactcgattttggttacttttcatgaatccatcttcatttttgggatttgattgatgatttcaatgtgaaatttgagggttttgcctaaaggttttataatatgaattttgagttttgaacatcgatttggagtcagaattgagtgaaactagtatgattggacccgcaattgaatgggttgtcggattttgtgagttttatcgggttccgaggcgtgggcccaggtgtgatttttcgccggatttggaatttgatgtaggattcgatctttatcatttggaattgtttccttgggctttatttgatgtattcgaatttcttttggctagttttgagatgttcgaaggtcactacacacgtgatggcatttttgaaacatcgctttgcttgctcggtattgtaattgacttgttcgaggtaagtgttttgcctaactttgttgagggaatttttcctcttatttgtcattgtttgctacctgtgagagtgatacatatatgaggtgacgaacatatatgtatgtgccacggttaatcatgcttgggggtggattatgttacgtttatgtttatagaatttcgtgacctcttgcttcatgcctcacttgatttctagttattaaaaacctagtattaaatgttagaatctagatttagcctattataacttgatcaaatttgatggaactctgagaatacattgatgtgtctaattcggtcatcctatgcataatcattaacacattgttacggccgatattttgagatgctagattccatacttgtactgttgataaattgtgggatttgtgaaagtacttgaattatgtgttccttgagggttcattaaatcgttgttggcttgtaaagcagtgattgagaactttgtttggaatattcgttgaacactctcctcgacgttatctatacttcctgccttgccattttattgatattcatatgcttggtaggaagagcgtaaagcacaaagagtgatgccgtgccatttcatatacattatcttgtgaggaagagtgaaagctcgaagggtaatgttgtgtcatttcatatacattatgatgttttatacgtcaattccacacaggggggggggatttgtgtggtatccaattttcgcgtgcactagctatagaagaaccaggttcttctatgtgttttaagctctactgttgcgaaataatcaatacagaaagtaaagaacaatgagatttttacgtggaaaatacctggctcaaaaggtgaaaaaacacgacctacttcccagtaggattttcccaaaactctttactaaatcagtgagccaaaacttcatttacaaaaactcttttgtaaatctaggattacctttaatccctttgaagcaaaatagcctctagctatttgcgacaaacttcaagttagctataacttgaaacacacagtacctattacaggcgcgtctagataaagctgataaaggtacaaattggatcacctactacaagtaactagtctaatagacaacatttggaactggttcttctagctggttcaagtagcttcagagtcgcacacttaaatctcacacgaactttttgcaaattgcctcgcgaattcttgctctcaattcttgcttaacttctacttttgtgcgtacttgtacaataagaacactgtaatttataggattagtagataaggaattaactaaaattctaatgcaattcttccttggtggaagagttctagttaatctcaactccttaaatccttccttatctatttgattccgttcttactgaataaggagtccttctccttatctttttgtaatcttttcgatcaggagacatctattaattcccagattttgtttatctcctgtatgtgcacctcacgtgcctttaactctgcatgtgtctatgtctctagtgatggacctggttcatctttgagttcctttgtcaatcttcaaaaccatttaatttcttgggccaacaaattccccctttttgatgatgacaaactctgtgcttaggcctgtaaccaactcaatccaacattgacaccttttagagtattaagcatttatcataaagaaccaggttcattaggttataaatatcatatgttcaaagtagcacatttcttcccccttttggcatcatcgaaatgttgcaaaatttagaaagtcccagatatttaagaattactcatggccactgggcaactgcaagtgcaatcatggattaataatcaaagtaaaccaagaattcaaactatcaaagaaaaagaaacaagattaagagcaaaaacaacagaattcattgatagaaagcattgttcatccacaatccacaaaaagaaataaaaacagttaacaccatgagcaaaaaaaaaaacaagaaaagtccctaatctgggtcactgaagtattaaggcaggctgggtttttggcttggagaagagatatcatatccctaagaattccctcattcttctccttttctttagcaagctcagttctgagagcatccctctcagattcaacctctgccaggcggttctttagccgaagtatttctacatcctttgccatactctcctgcacaagtgctctaactttgctgttcacaggtgtcttcctagatgaaccagattcattagcaatgacattgacctcatagtaacaagctagaagggtatttatcccaaatgatccttgcatgtggccatctctgctttatttataggcaccttgtactgaacaagtaccgaggtgagaatgaagccatatggaatggcatgggatttggagccattaccactctgttcaatagctgaatgataagtagggccagtttatctgcctccactatccaggcactccattagaactaagtccatgtagttagcaatgtgcctcctctcctgtcttggcagtacacacttgttgataaactcaaataccactttgtgtaggggctttatctcactcttgtagactgccttagattcaacctcctcgtcattgtcgcagaattttcttgtgattcgcagagcaattggaagagcatctaaacttggctatttttgcctagtatagtcatcattgccttcatatggaatgccaaggatctctcctaactctttggcatcaaaagaaatttttatccctttcacttggctagtgactctgccatccttgattacagctttggccatgaattcgactatctcatttctggccggtcgcccatccaactgaaggatcatgtccttccagcccttcaattccagcttatctaacaataagaccatgcctgcttcttccaaatctttcaacaacctccccttcagaatggtgcgcttcccaaattttgtcaaattatcctttttcccctctgactcaactgcttctttatcactccagtccttatcttcatcaatttgaactttcttgggctttacaatagacctggttctcttggctacgtttgagggttcagcagacacagatgcatagttcttggaggaagtcttggctttctttggttttggagtttggatctcaacctttgccatttgttcaccttgatggaccaggtccatctcctcaatctcaacagcctctacaggctcaacaactttctcctttcccttttcagctctctttctcttactctcttccaaggctttctgtaactcctcctcactctgccttaatgtgtttctagtggttcttcctcttcactagcagaaggagtggctttccttttcttactttctcttgcatttccagaagtttaagccttgggagttctttcttctttggcttgtaactatcacccaacttttttagaaggtctgctagggtttcctcagtagatgaaccaggttcatctgtagactttcccagatttttcaacccctcagctgcttctcctgattcacttccccctaacttcttgactccttctcctactaccacttgttcagtttcacaaatagtcaaacgagtagttttttcccctgtttccctcactttactccgacctccctctctcttctttttctttctcaattttatttttaccacctttttttctcatttccggcaactccaaatctatcacagacccaaccaacacaaacctgttttctaagttttttgctatttcagacacagtctcagaagtgatctttggtacagatgatacttgttcagaatcagatgatcctggtgcttcctcagtagctgatataaacgagtcacttgaattatctgattcttgtgcctgactagcttgaagtttggcatatattttttttgcaagagaacctatggctactatttttctggcaagcatcttaatccttctttttctgggttcggagtttgggctagtttgaggaatggtgggactggattgagatggattaggtcttggtggtggaggggttgtagaagtcaaagatggagtagcaggtggtggagtaccagggttatctgaagggttagaaattttcgattgaagatgaaagaaagagaaaaaatattttggattgagaatgaaggtaaaggaagatggaagggtttcgacggttataaagatgatgagtgatttcaaaggttataatggggggttttaaaaggggatgggtaattgatatataacggcagcatttttgggtcaaatagaagtttaatcacttctgtaatttgtcagttagaagtgacagttacagcttccctagtttctaggctttttaattcgataactcttagggtagatggaactggttcaaaaataggataaagtatatattttgaaaagatcttgtttaggtagagttctgctcatgattaactattaatatttcaaagtgtgtatagtggagaacacatacctcgcctttcagatgaaccagcaccgatggaccaggttcatcatgtaagaatcctcttgatcaagcctctattttcaacaatagagaaaaacattattagtaaccagtgagtcatatcaaacatggaaaaagagtgtgctatttacagcatgaggctgagcaatagttaatctgattatttacacaaattttagaatttctagccagtttttttttcattttttcatgtacattctgaactggttcaattaggtgatcttaatcaccctaaatctaacctgtttctttcaaaattctctctacttggtgcttttgttaagatgtcagcaatctgtttatcagtagcacaaaattcaatagagatcaatctcttctcataaatgtcccttaaaaaaatggtgtctaacatttatatgctttgttattttatgatgaacagggttctttgtcatactgatagcactaatgttatcacaaaatatagggatacatcctacattgattccaaaatccatcaattgttgtttaatccacaaaagttgagcacaacatgatgctgcagccacatgcttagcctcagcagtagatagagccacagaattgtgctttttagtggcccaagacgcgaggtatgagcctagaagtgtgacatacctgaggtgctctttctatccactagaaaacctgcatagtcagcatcaacatatcccacaagatcaatcactgccttttggataccaaagacaaagatcagaggttccttttaggtatctcaagattctttttactgcactcaagtgggattcctttggattagcttgaaatcttgcacaaagtcctacactgaaaataatgacaggtctactagcagtgagatacaacaatgaaccaatcattcccctatacaactttagatcaacaatgaaccaggttcatctatatccatttgtgttgttgcaataggagtgtcaatttctttggaatcttccattttaaaccttttaagcaactcttttacatattttgctgatggatcatagttccatttgaattttgtttaatttgtaagcctaaaaagaaattaagctcaccatcatgctcatttcaaattcactccccattagtttagcaaattctttacttaacttatcagtagttgctccaaagattattcatcaacatatatctgaactaccaagagatctttacctttttctttcaagaaaaagtatgtcaattttacctctcttgtagtcatgctcaagaaaactttgataatctttcataccatgctcttggagcctgcttgagccataaatgctttgtcaagtttgtacacatgatcaggatctccttgtttcaaacccggaggttgcttgacaaacactttcctttagatagccattaggaaggcactcttgaatccatctggtgaagggtgaattccatgtaacagacaaaggctatgaggagtcttattgcttccaaccttgcaactggagcaaaggtttcatcatagtctatccctcctcttggctatatccttgaaccaccaatcttgccttgttccttgtaactgttccatcttcatcaagtttgtttctgaagacccacttagttgccaattactgatcttccaagggtcttggtaccagatgccaaacttgactcctttcaaattggttgagttcatctgcattgcatttaccatattgcatcctgcaaagcctcagcaacatttttaggttcaataagagataagaaagcatcaaaagcacaaatattcttcaaagaagatacggttttgattctagaggttggatcagtgataatattctcaatagggtgagaactttgatatctgtatggtttgataaccaactggttactccttgaagttccttctatgccttgttactgtggaacaggatcaggtacatgttccaataaggtttgggaattagtttgttgttcagttccccctgtcatgttgcccagtatggatgaacctgttctatcacctgttccttcctccagtgtagttccagttggactgagtttctgaccagcccaatttcttcatcctcttgttcctgcctctcaaaaagaatgttagtttcgtcaaaaactacatgcacactttcttcaacacacgtagtttttttgttataatctttataagccttactatgtgaagaatatcccaagaatactccctcagcacttctgggatcaaacttccctagggaatctttaccattgttgtgcacaaagcacttgcaaccaaaagccctaaggtgggaatattggattttctccctttaagtaactcatagggagtcttctctacaagtgatctactcatgcacctatttatgatacaacatgcagtatttatagcttcttcccagaagctatgaggtagtttactagaaagaagcatagtcctagccatatcttcaagtgtcctattctttctttcaaccactccattttgttgtggagttataggggaagaaaaattatgatttatgccatgttcatcacaaaattcagcaaatttagcattttcaaattcagtgccatgataagacctaattgatacgagttgatttcctaattgtttttaaatttttctaacaaagaagtaacatgtcaaatgcctcatctttagattttagaaataatgtccaggtaaatctagaataatcattaacaagcaccatcacatatgtcttaccacctctgcttaatgttctcataggaccacagagatacatagaccagttctatcttctagtggtacttaccattttcttgcttttaaaaaaggatcttacctgccttccccttacacaagcctcacaaactttgtcttccttgaacttaatgttgggctagcctatcactaagtccttggagactaatttgttgagttgactcagacttgcatgtccaagtctcttgtgccaaaggaggggatcactgtccagcacacttaagcatgttaattcattttctgacagtatggacatatctatgatataatattgttcactctttttccctgcaaaacaatcgtgttagtagtgataagatttattacaaaacattttgtaaaggtgaatgctaccaagtttcctctgtcacacagttatgacacactgattaggctatattttaagccatctatcaagtagacattctcaatggaacgtgtgtcatccttacctaccttaccaaccccaatgatttcacctttctttccatttccaaaggagacatttcctcctttgaggtcctcaagtgaaaggaactagtccttgttgccactaatgtgttttgagcagccattatccatgtaccatatttggctacttcctttcacttgaacctacaaaagaaaatcaggggttagtcttaggaacccaaactagtttgggtccctttctatagcaaaaggatgaattagattctttttagcccaattggtaatcaatcttccttgaacaaaacttttgttctattgactggccgtgctcttttgcattacattcacttttgtagctaccagtattatcacaatgggtacagattttgttctcaggaagagtgaggtgcttgcttttagtatcccatttgggaagctgattcccaaagccaagttctttcctattgctactgtgatgttcctgtagccatgtcaaagtatcgaggatctgttccatttacaagttctgttcagttcatgcttgaacttaccaagttcctccttcataactcttatatgttcatccttcctatacaactcatcttttagtttacctacattttcttccaaggtgagtcgggagctatcagcttcttcttactagttcgtagtttcaattttaaattttcagattttagctctaggacatttgtttcaagtggatgaaccttgttcttcagagaagcatttcactcatagtcttactgactctgatttccaggtttttacactctgcttttacaatcacacactccttagacagttgttccttttctttattaatgacctcagattcatcaataaaatctagcaatagttcaaagagtttttccttatacatgaacttaatcttgtctttgagatgaaatatacttacctcagattcctcatctgatttgccaatttccataagtgtttgttcatctccatcttattatctgactcttcatctgaactttctccccaagcagcaaccatagcctttgttgttcctttgttctttttgggatgaacctgttccttcttctggttcctttgttcagacctttccttcttccattcaactttccactgagggtaattcttgatgtgatgatcagtcttccacatttgtagcagccctcattagtcatttttttcagtacccttgccttgttgtagtttccacctcttgaggagccctttcctctcataagatatttcttgaagtccttggtaatcatggccatttcattttcctccagatctgctctttcagtaattctgagtgctagactcatttccttcttgggagcatccaccttcatggtctaccttctaatttcataggcagtgagatttccaatcagctcatccagtttaagatttgcaagattcctgggttgcagtgacttgcttttccaagagactggcagaacccttgttagaatattttcaaccttgtcttcctcgagaagagtccttccaagagatttcagttcattggtcactgtagtgaaccttgtgtacatctcatgaatggtctctccttccttcaaagagaattctcatattaagaatatagtagagtacctctggatcccttcacttaagcaataccttcatgagccacttgcaaagtgtcccaaatttcttagtagtgttacaactttgaattctgctgtactcatctggaccaagtccacatacaagccacttcttagccttagcattcttttcccactttctcaaatcctcagcagtgcaacccgctcttgtttttagcacatctactccttcagcattcttattcatggttgccaaaggaccattagtaacaatgtcccatagctcgtagtcttcaccaattatatggtctctcatcctgttcttccaccaggagtagtactggccattggagagcggaggcctagtagttgattgtccttccagttcccaggtggtccactcatcttgatcttttcctaaggtgttagcctcttcaaggataacctgctctaataccaattaatgtggcgtccgatttttgcatgcactagctatagaaggaccaggttcttctatgtgttcctacctctactgtttgcagaataataaatacagaaagtaaagaacacagagatttttacgtggaaaacacctggctcaaaaggtgaaaaacatgacctacttcccagtaggatttttccaaaactctttactaaatcaatgagccaaaactgcatttacaaaaacttttttgtaaacctaggattacctctaatccctttgtagcaaactagtctctagctatttgcgacaaactccatgttagctataacttgaaacacacatacttattacagacgcttctagataaagccgataaaggtacaaattggatcacttactacaagtaactagactaaaagataacagttggaactggttctcctagctggttcaagtagcttcagagtcgcacactcaaatctcacacgaactgcttgcaaaattgcctcgctaattttgctctcaattcttgctcaattcttcttttgtgtgtacctgtacaataagaacactatgtaatttataggattagtagataaggaattaactagagttctaatgcaactcttccttggtggaagagttctagttaatctcaacttcttaaatccttccttatctttgatttcttttcttactgaataaggagtccttctccttatcatttttcaatcttttcgatcaggagatatctcttaattcccagattttgtttatctcccgcatgtgcacctcatgtgcctttaactctgcatgtgtctatgtctccagtgatggacctggttcatcttagagttcctttgtcaaacttcaaaaccatttaatttcttgggccaacacattatcatgtgaagaaaagtgtaaagtatgaagggtgatgccgtgccattgtttatattcattatcatgtgagaaagagtgtaaagcacgaagggtgatgtcgtgccattgtttatattcattatcatgtgaggaagagtttaaagcatgaagggtgatgtcctgccattatttatatcattatcatgttagaaaagagtgtaaagaacgaagggtgattccgtgccattggttatattcattatcatgtgaggaagagtgtaaagcacgaagggtgatgccgtgccattatttacattcattatcatgtgagcaagagtgtaaagcacgaagggtaatgctgtgccattgtttatatcattatcacttgaggaagagtgtaaagcatgaagggtgatgccgtgccatttcatatcattatcaagtgaggaagagtgtaaagcacgaagggtgatgccgtgccattccatatacattatcatatgaggaaagagtgtaaagcacgaagggtgatgtcgtgccatttcatttatattgttatgcttttaatattatgaggtcatggcacgaagggtgtttccggtgcatgtgaggatgagggacatgcattatgatgtgatatctgttttccgtgtgtacgtttccgcctttaccttgagttgtcattgtcgccattacatattttgtgtgaaatgttgttattgtcgcgtacttgacctttatctcaatagttgttgtgttgtccataccttttttttgcttaacttgcatatgccatgcctatttcctgcttttataattatattcatgttgtatctattctgttgcaccttagcgtaattcttcctccatgctagtccttcatgtccttatttgttaacttgtgaagatcatgtgtttccttcttgttttctatatttgtacttaggcctccatcatgctagttaatggaaattataaccccttttttctaattgtggtcattacctcagtgctctctacttagtctgttgctgatgttcttttacacattctcatttattattattgcttgcatattcccttccttgtcatttctattaacgatatttctatcatttggttggtacagttttacgcatatatgatgaggatgagataagtgcacgaagggtgttgacgtgccgttagacttgatgtcttgagtactttatcaaactatgaaagtatatgaggtgattgttgtagttcatgggttttcgttttaaggaaaagggccggttgagatcttgaaactgttaaattgtgattctttgttatctcgtttatttcctattgcagtcgcatggtgtactctattctattattctgtcttttggttctattgctagtttacattatagtgtttattaatgagtatcttttaactaaaaatctcgtcactacttcgacggggttaatcaagatacttgcccatacatggggtcggttgtactgatactacgcttcctgcacactctgtgcagactattggagcggagctgctgaataagttgggggctgaccctgaagatgttcgtgtgttctgtatattagctgccacttgtccttggtagttttagacattattaatctgttcacataattttcaaacagaacgtgtagaaaattcataccatctttgtatattctaagtcttagaagctcatgattcgtactatcaaatcttgggtaaatttgtaaaagtttcgataaatcctaatttaatttacgataagtttcttatagtttttcttttattaattggtttacctagcgggtcaagttaggtgccatcatgacctgtgatttttgggtcgtgacaccagccaccacccacaaagaacccccaccagccgcactccacacacaacaaacacagcagccgccgctcccgccaacagccacacccgccttcaccatgctgccgcgggcttcatcaccggcggccaaccacccatctatttctccagttccggcctccaccacagaaaaagaaatcccagttgtcgttccccctccaacctagagcagttgcatcacccccaatccagctatcgtccaccatcccaactcagccgcacttcagccctttccgtcatgagctcgccgcaatcaatggcttcataaacaaaaaaaacgactctcactcctcactccccatttttcatagacggatcttctcttttactattagaaattcattttctctaatacactcacatacctacttaggactcacagaaaaaagaattgaaaagaaaaaagaatttcaaaagtggccttgtctagctcttttcagtgtttgttttcggcagtttagtaaaacgagaaactgaggttcgaggttcggtgtcagtcgccgattcgagttcgtgtccgtggttctttacatctttgagttcaacatagtgaatcatcagttttccgtctatattgaggtccaattctttcctcctttatccattttattcaagcttaatgttaaatgtttgtttggtgatgtgattcctttacttgtgtaattgttctccatgttttgaatttgctcgtttaattatttgctcgtgcttactcgaattgtgtttatagttgaacatgattttatcacagtatagaaattgagttgcattcatcaagtaaaccacatcaaattaaactaaaggggttcgggtgctaaaattcatgaaattgagccgttaattggtttattgctttttactccctatattcactaggagcatgcttaggccgatcacacttgggtaggcaaactttagatttcttcttttatttgaggtaagcggttgtccctgttaatgattattatatccgggaatgcccgaggaccttgtaaatatatattatccaggaatgccttcgaagtactttgtaaatattctaggggccgtgacgaagttgcgaaggaagcatagcgtagtattttatttttatttttattttccttatatttgtcttttatttaggtagggacaacctcgaacctttttgcgtgtgctttcttttgtgtgttttcttttttacctcaatttgaatattttaaaagccaaccagatcgagtacgcaaccgtgactttcacggactcggggaatgcctaacaccttcaccctgagtcaaatgaaccctcttaccagaactctggtgcaaactggtttaagagtcaaatgtgtttttgaaaggacatcgttatttaaaaaaaatggtgacctggcacaccgaaatcaaatgccaggtggcgactctgaaaatccttttaaaacacaaatctttgtcactttataattgaaaacccttttgaactttacaaatcttcttattatttaatagagggtttagtgagttaaaaaaaagggaatttttcacaaaccactattttttagtggttattagctagttgtagctaccatttaatatagtacttcctatagctatattttcagttttttatagtgtattcgatgtatttaaactactgtattcgtgaatacagtagcaaaactcggtgtgaaacatgggcttacaactggatagacgaatgtatgtgggtgtatgtgactgtattcgactgtatgtcgtaaggtaaactgcgcaattccaggcctggacagattttttttaatggaaactgtataaattaacataatagactcctaatataactcaactaacacaattacatcacccatatatcgttttcttacgcgaaatctgtttcttcccttttgctgttttttttccgtgtgtgcttctttgttcaacaaataaaacagagaattcgtgatctattaaataaaatagagatcatatatgcagaatttgtttcttcccttttcttctttttttcatgtgtgcttctttgttcaacaaatataacagagaattcatgatctattaaataaaacgaagatcatatatgcgaaatctgtttcttcccttttttgtttttgtttcgtgtgtacttctttattcaacaaataaaacagcgaaattcatgatctattaaataaaacaggagatcatataccaactatatttagttggtgtattaaatctgaatacataattacaatacggctattatataattcatgatttctgaatacagatgagtacaatctgaatatatagttggtatataatctctaaatattaaatatatgtattcgaatacatctgaatacagatgaatacaatctgttatatacatacgatatgattgtattgtaaaaagatgtaatatttcattcatcagaactgattctttttttaatacatataaatacacctaaaatcctaaatacaaaatgacattttgtatcagggattatatatgatctctgaatattaaatacatgtattcagatatcctgttgaaatacatatgaatacaacttgttaaattaatatgaatgcaacctgttgtattcatatggatgcaagatgttgaatacagattaatacaatatgttgaatacatatgaatacacctgaatacatattaatacaatatgttatacacatattagggtctaaatatgttttgtataaaggtctcatagactcagcccccaactccctcatctttgttcaagaacaatcctaatgtcatcttgtcaagaggatcacgattctgactcgaaactcccaacccttataaaccctgaacctcactgttcccactcatcctgtatagtagacgagcaaaaatcatggcaagacgttgcatatcattttgggggattcttctatctaccagtagatcatcaacagtcaattcctctccaagtgtccaatccattctcgtccagcgcctttaatctttccgtaatggagatggcgtatatgaaattagcgtggtgactgaaaatggggaagagctaggcgatgtgggtgagagaaatttgtgaattgcagaatcgtggtttctagcaatgggggaagagaatgtcgtatatcaaattagagagagatagaacgtgggagtgagaagtttacatcaaatacggtaattatgtgagagaaaaatatgaaaaaggagagagaaaaataacaaatagcgtatctggtggcttaaaggtaggaggtaaccataaatagagtttttgctataaatattaaaaggtagatatagaatataatttttttaaatggtatttatttaaaataaataaggtgttaacccttactataggaggtaaaaatccaaaaacaaaaaggatgtgacaagctgggctagcccaacgggcgaaacctatattgacgactctactagtgtcttattcttgatgccttcgtacattttagcatctgtaatttgtttgataagatattaatgaaatgctttgtatacgcataattaggagatttaggggacaatttttaacagattaatatctaataaatcaccaacatttgatatatcctttttggaaaagtagcaaatgataatattttacacaaacaaaatatcgaaatccgaaaaaccaatattctatcagagacagagttagcctatagtgcgagtattcgatcaaatccagtcatttttgcttaagtatttatattaggaacttcattatatgtgtataaatatttaattttgaatattccattaactaagatgactatgatatcgatgactatctgtgataaattaagaacccatccatgagaaataaaccaaaatgtagctgaaatggttattggacaataattaatgaagttttccaatatctttctcaagtaagtaagaataatgaaggttaaaatgagttaagagttcatttattatggagttaattttatccatgtcattaaatttttgtgttattactcaaaagttactttttttttttattacctaaaaatcatttaactttgtgttcattactcaaaagtcactattcttttttttgttacacaaaaatcattttattttgctctagttatcacaaaaatcacatttgccagattttataatacttttacttgaaaaatctattatgcccttggtattatataattctttctacactatatactatataatatatttttactgtattttattcataaataaaataatttaatattattttatttattatttttataatatattcgtacatttatttttccataactgattttatttttaacttttaccatatgaaactattcctaggctcaaaattctaaacgtacttcgattactccgaaacgtactccaaaccaaatttaaataactttaaaatcttcaattagtcaaccttcattgttaagcgccgaaacgcccccgggttgtctaaaacccgacccgaacatatgtccaagtccaaaatcattatacgaacctattggaaccgtcaaatcccgattctaaggtcatgtcctacaagtgttgaccgaattcaaacttggactttaaagccaaactaaggaaccaagtggtcccatttgaaccagaacccttccaaattctgaactaaccatccttgcaagtcataaaatagtaaaagcacatatgaagagtcttatttaggggaacagggttgtagaaggtaaaacgaccggttgggtcattacaagtggttaagaacattgacgtgcgatttgttcatagaaaagttagtgacaaatttaataacttctaccaacatatcttgaaaattaacattaaggaaaactaaatatacgaatatattataaaaataataaataaaataatattaaattattttaattataaattataacgacccagtcggtcgttccgtagaattagccccgttattcctgtttctgcttcgttatgcatttcttagtatgtttatgatgtgtcggggtcggatggttcgggttcggagtggtcgtggtgagaattaagacacttagtctctcaaattagccttatagttgaaaaaaaatcaacggggagttgacttattggtagacgacctcgaaatatagattttatagctcggatagcttcgttaggtgatttggaacttaggatttgttcggaatgtagttttgatgtccggtgtagaattaggcttgaattggcaaaacttagtttttggcgatttctgatcggcagtgaaaaataggctatcggggtcggaatggaatttcggaagttggagcaggtttgtaatatcattttggatatgtgtgcaaatttcaggttaatcggatgtgttttggatagtttcggcatccttgctgaaatttctcaaagttcataggcttggatagtttcggcagcatgctacactgttatgatatgtgagaggccgagagccagagtgattgatgccatgatttgtcttgttatagcgcttgggctataggagcccctccggaatctgtacaccccagtgaccgcaggtacctactgagtgcaagtgccgagtgacgagtgattgggagtcatgattgacggtgaggttgcctgaggggctgatactgtgtgattgtgaggtatgctgagtgactgattctgagtgatgatttgctcgaggggctgatactgagtgattgtgaagtatgctaagtgactgattctgggtgatggtttgcccgaggggctgatactgagtgattatgaggtatgctgagtgactgattctgagtgatgatttgcccgaggggcggttaatgatgttgttttacctaggtttctaattatgattcatttcatttttatactaagacttcttgggcatttttctgaaatcattgaaaattatcttttcaaaggattttgacttaaattggcttttaaagcgtattgactaaataaatacattgtcgggataaagattttgcttattgtgattcggtgatttgctcctatgtgtttcttactgtttagatttgatttattttcattactactgagttggcgtactcacattacttcctgcacccctatgtgcagattcaggtgttggtaccgagtgctagttttcttattacacgtggagccggagttgggacttcgaggtagttgttcagcgtccataacatctctttcctttttcttgttttgtatttagttcctcgttcgagacttgatgtattatgacagcagagtttattttgttccattcgtagttgctcatgacgtgttgacccaggtcttgggagtagtagttagattatttatttcgttgggtttttcttaaagtttagaaatttgaaaggtttatgaaatgttggaaacaaattttggaaattatgaaaaatattatgacaatatgtgattgttggctagcctagttccatgataggcatcatcacggccggcttaggattgacataaataaaatacctaggtaaaaatatattatatagtatataatatagaaggaattgcataaatatgaagatttatataatatcatgggcataatagacttttcaagtaaaaaaattataaaatttggcaaatataacttttgtgataactagagcaaagtaaaatgatttttgtgtaacaaaagaaagaaaagtgacttttgagtaatgaacacaaaggtaaatgatttttacgtaacaaaaaaataaagttatttttgggtaacaaatacaaaagtacaatgaccatccataaaattaactatcatttatgccaaagtaatctaaagtaaacagaaaattgcatcactcacataggatcataaatgtatctaagattattgtattttgggtgatttgtgtaatctcaagtgatcatcacattaatcagattcatcactatttcaactatataacatagcaacagtcttatggttatgcattccctactgaaaacataggcaagcacaaaataatggcacgttactcaatatcttcaacaatatttctttctttggcttttataattgtccctgatcatattataccaaaaactctcgctacgagtcgatccatcgatgatcaacatgtcaatgtcgatgattatggaccccctagagcgagtcatggaccaaaacaagaggtagagatcaacgattatccgcccataagagtagggcatggatttggtattggtcttagtacaccaaaagtaggagaagaggtcaacgattattcacctgcaagaccagaacatgattttacaaatgatcatgatacactaaaacaagttgtgaagatcaacaattacttatccacaagataacaaaggtagagatcactgattatctatccataacacaagggcatagatttaccaattttattggtacaccaaaagggtcaggagtcaacgactctccaccaacaataccagggcatggtgatgcaccaccaaaacaaagggtagagattactaattatctgtccacaacccaagggcatagatttaccaattgtattggtgcaccaaaagggttggggtcatcgattccccaaccacaacaccagggcatagtcctgatattggtcatagtgatgcaccaccaaaacaatgggtagagatcaccgatgattatctgtccacaacataaaggcatagatttaacaattgtattggtgcaccaagtgctaatggtctctcagctactggaaggtatactagagtccccaaactatctgctctgcgactcaaggcatcggccactacattggccttccccaaatggtatagaatagtgatatcatagtccttgagaagctccaaccacctcctctgacgcaaattcagatccttctgcttaagcagatgctgcaaactacagtggtcggtgaaaatctcacaatgcaccccatacaactaatgacgccaaatcttcaaggcgtggacaatggttgctagctcaagatcatgcactggatgattcttctcatgaaccttcaactgtctggacgcgtaggtaatcaccctactgtcctgcatcaaagctgctccaaggccaactctcgacgcatcacaataaactgtataggaccctgaacccgtaggcaataccaacactgatgctgtagtcaaggatgacttaagcttatgaagctcttctcacactcctcagtccacctgaacggagcacccttctgagtcagtctggtcataggtgctgcaatagatgaaaatccctctacaaagcggcgatagtaccctgccaaaccgaggaaacttcggatctcggtagttgatgacagtctaggccaactatgcaccgcctctaccttctttggatctaccttgatcccatcacaagaaaccacatggcctaagaatgctattgaatcaagctagaattcacacttcgaaaatttttcatacaaccttttctccctcaaagtctgaagcacgatcctcaaatgttgctcatgatcctctcgagatcgggaatataccaagatgtcgtcaataaaaacgatgacgaaggaatcaagataaggccggaacacacagtgcatcaaatgcataaagactgctggggcattggtcagcccaaatgacatgacaagaaaaacatagtgaccatatctggtcctgaaggcagtctttgggatgtccggctcccaaatcttcaactgatgatagccagaacacaagtcaatcttggaaaatgcccttgcaccttgtaactggtcaaataagtcatcaatgcgaggtgagggattcctgttcttcaccgtaaccttgttcagctgccaataatcaatacacatatgcatagaacaatcctttttcttcacaaataacaccggggcaccccaaggtgacacactaggctgaatgaatcccttatctaggagttcctgaagctactctttcaattccttcaacttcgctggtgccatacgatatggtgagatagaaataagctgagtgcctgacaccaaatcaataccaaaatcaatatccttttcaggtggcatgcctggcaggtcagcaggaaacatgtccggaaaatcacggaccacaggaacagaatcaatagcgggagactcaacactgacatccctcacaaaggccaaatacgataaacatcccttctctaccatatgctgggctttcagtagaaaatcaccctactaggcacatactcaatagaacctctctattcaaccctcgaaaattgtggcatagctaaggtcacggtcttagcgtgacaatcaagaacaacatgacacgaagatagccaatccatgcccaatatcacatcaaattcaaccatgctaagcaataacagatccactcagatctccagacccccatagatatcacacaagaccgatacacacggtctacaacaatagtatcacccaccgaagttgacacatgaaccgatgtaactaaggattcacgaggtatatccagaaaatgagcaaagtatgatgaaacaaaggaatacgtggaaccaggatcaaataagacctaagcatctcggtgacatactgaaacaatacctgtgatcactgcatctgaggccatagcatctggtctagctgggagtgcatagaatcgggcctgacctccacctgatcggcctacccctctagggaggcctcgagctgcctgacccccacccttagcttgctgggcgagtggtgaagtaactggagctgaagtcgagggctgacccctctgctgagatgacccaccctggagacgaggacactgtcttcgcacatgcccaaactctccacactcgaaacaactccctggagctagatacggggactgaagggaacccctaacactaggataaccaccagaagaaccatgcataaaggaaccctggctcgatggtgcttgggatgaactctgggctggaagagcactaaatgaaggaccgcctggatgcgaattgcggggtccaggccccgatgatgcaccactataagctgggtgagctggctgaggaggcctaaatgagcgacctctactatgctgaaactgtcctctgaaggagcactgctaaaactaccaaatccttgaggcctcttggcctccctctcatcacgcttctgacgtcgaactacctcaatatcctgggaaatatccacaaccatctcaaaagtagcacctgataccctctctctggtcatcagaatacgaagctgataagtgaggccatccacgaacctcctgatcctttccctctcagtagggaccaactctaaagcatgatgagatagctttgagaacctcatctcatactgtgtcactgtcaactcaccctgacgcagctgctcaaactgtctatgcagctcctctatgtgagactgggaacatacttctctaaaaagagagttgaaaactgctgccaagtaaggggtgctgcaccaacaggcctacgcctctcataagactcccaccaagtgaatgcagctcctgagaactggaaagtagtaaacgataccccactagtctccaatatccctgcagtgcaaagaatcctctggcacttgtctaagaaaccctgggcaacctcgccctcagcaccactgaatgtcggaggctgaagtatactaaatctctccagcctacactgctcgtcatctggcatgacaggaatcacataatcctagacaggtgtaaccggctgggctggagctgccccggtgtctgaagtccttgaatgacctactttggtgtacgggcggcagcagtcgggtgcctcccccggactgagaagtagcggctgtagtagaaacagcaactgcatgtgcaagactggtgcacacggtcaaaatccgagccagagtctcctgaagacccggaatcacaataggcactgtcggtgcctgaaccggtcccgctggaacatctgtggcgaggacctgatcctaaataataggtgggtccacgggtactgtcccagctgctgcgcggccgcacccctcctctaccacagcctcgatcgcggcctctacctctcgctgatccagctggtgtctggtcaccctggtcggtagcgcgtttcctcaccatttgtgagagagtgaaaacaacagaagtttagtttctagaattaacagattgccacgacagaattcaagaatgtgagatttttcctaaggtactgtagcctctcgaagataagtacagacgtatccataccaatctacaagactctactaaacttgctcatgaccggttagtcctatgtaacctaggctctgataccaacttgtcacgacgccaaacctaaactggttgtgatgacgcctatcatgaaactaggctagtcaatttaccaaaatagcatttaaggattttcctcaagtttcaagctgatcgatatttcgtaaaatttcccgggttaacatttcaaaacaacaaaattagataaagcatttaaaataccccaaaaaacctagagtcaattttcatgggcatctatgaaatgatacaatgaaatgcttcttcattactacaaccatttctaggaatagatagaaaatcacaggataagatgggaaaagtgtatgctacggatgccgaacagctacctcaaaatcccgaatcggctccatgagaatgcgaaatagctagcgctcagacccagcacctgaatctgcacacagggtgcagggagtaatgtgagtacgccaactcagtagtaatgaaagtaaataatgtctaaggttatgaaacacgtaaaaacagtcatcaatgcacagtaaatgaaaatcctttctttcagaaacatagatatgatatcttgtaacatttaaaaatagatttcagtaaaaacatccttgaaatgtaccttttcacaattttcatagaaatcaaagggattcagcatataaatgatagggttcataaactgtctttcagatgaaacatgtatcataaactgccctcggcgtatcatcactcagcatcagtcactcaacatgcctcacaatcactcagtatcagcccctcgggctacctcacagtcattcatgcctcctaagtcactcggcactcggcactcggcactcggcactcgcactcagtaggtacatgcgctcattggggtgtacagactccggaggggctcctacagcccaagcgctaatatcaagccatctcgtggcataatcatcaggctctcggcctctcacgtatcataagcagtgtaacatactgcggcgtgcagcccgatcccataatatcctcacaatataggcccttggccacattcggtcaggaatctctcatgagccactcgggctatcaataaagcggggtactcgacccaaaatatcattttatatcacaaaatagtgtaaataaaattgagtttcaaaattagttaaacatgatataactgaatgtaaatcataagtcaacacggtgagaaatagcagcaaacagcccccaaaggggtccaaacaggtcggcacaaggccccaagcatggcgtacagcccaaaatatagtaatagtcttaaaacatgaaatatcatatgaattggaactaatacacaacttaatagttgccacggggcagaccaagtgacaagcctccaacagtgctcgccatacactcgtcatctagcatgtgcgccactccaaaaaccctcaagacaaaatttacagtcaatacttacctcaaaccggccaaaatactaatccgcggtgcctttgcctctcgaatcgaccttcaattgctccaaatctaaccaaaactatatatatatatatatattatatatatatatatatatatatgctaaggaacaaatcccactcaaaaattatcaaatttaaccaaaaatttcgaaattggccaaactcgactcccgggccaacttctcggaatttgataaaaatcatatcacgagaatccttatcctccacgagtctatacataccaagaacatcaaaatcgggcctcaaatggcccctcaaatcccaatcaaaggtctccaattacaagccctaatttttcaattttaggatttaaattccactaatttcatgtctaattagttagaaatcaccatagaatcgtgtattgagttcaaaaaccttacctccaagtgttttctttgattccctcttcaatacctctcaaaaagcttcatagttgttcaaaaatagtgaggaatgggctaaaaatcgcgaaatgggttttataccttctgtccagattttccttctacgcgaacgcagctgccctctcgcgttcgcgtaggccaaactcaggttgcctctaaaatacacatcgcgaacgcgtccacagcttcacaaacgcgaagctttaccaactccctccttcgggaacgcgttccttgacacgtgaacgcatagacaaaagggacctggggtcccaagctgccactacccttcacgaacgcgggcccctaaatgcaaacgcatagagtacttccccaaccatcctcctcatcacgaacgcacagcacaaattcctcagctcccccatttactcttcgcgaacgcgatgctccccctgcgaacgcgatgaacaacatttctctccaacaacaccagaaaatctgacaagttttaagcggagaattggttcgttaacaccccgaaactcacctgcggcccccgggacctcaaccaaacctgctaacacatcctctaaccttatttaaacttagtggagcccttcgaaacactcaaaacaacgccaaatcaccaaattcacctcggattcaagcctaagagcttggaaacttctaaatttcgctaatgatgccgaaaccacccaaaacacgatcgattggcctaaaaatttgcacacacaaccaaaatgacactacagacctgttctaacttccggaattccattccggccccgacatcctattttccactgccgaccgaaaatcgccaaaaactcaatttcgccatttcaagcctaattctactccggacccctcgaaaccacattccgaacacactcagaagtcccaaatcacctaacgaagctattcgaactctaaaatccacattccgaggtcgtttattcctaagtcaattcctggttgacttttccaactattaagtcgacttaagagactaagcgtctcatttcacaccacgaccactctgaacccgaatcaaccgacccaatatagcataaataggctaagcaacacatgataaagcagaaacaaagaaatcggggctaatctcacggaagaccagctgggtcattacccccacctacgaaaccagtgcatggtcttggaattgatcacggtgtggcaaaacaagggacaaagatcaaagattacccccacgagaccattgcatgatcttgcaattgattatggtgcggcaaaacaagaggcagagatcaacgattacctacccacaagatcattgcatagccttgcaattgatcgcggagtatcaaaacaaggggcaaagatcaacgattacccacaagaccaatgcatgatcttgcaattaattatggtgtgacaaaacaaggaataaagatcaatgaagcaccaacgcaaggataaattaatcatctattttggtaaatttttgtagatgtatctgaaattttgattgtactgtgagaagttggtgaatttcaatttcaattaatagcaaaaaatttgcttaaaaatctgcttcttgattacatgcatgttttagtagtcttgatcttaatgaatatcaagttatgttagtttattctttgtaatttgagtcaggattatgaagtcatcaaataagtaatttggtaaataagtaaaaatgaatcaaatcaatcaaattaaaacattgtagatttttttttaagaatgctcagtgatgacatgtgaatcaaactataaatagaaccgctctctttttctctatagttcttttgatctcatctggtatttgatacttgcattgggacctgattaaattcagattcacgtcgtaaagttcatatttagagtaaggcacttcctaacaaaagcgacttcatacgctatttactactctattacaactcttattgatctatcattctatcattcaattttgatcactttggttgctagcctagagcggttattatgggggcttttgcatctatacccgctttttggatcacgttataacttatacctgcttttgcaaaaaaaattacaagcgtactcaattttcacataaacttcaggcatacgggcctgaagtagcaaaggcaatcagacaaacttcaacattctaggttttttcaaaaacttcagcagaagtgctgaagttatttagttcatttgtaaaaacttcagcactaaataagctgaagttttgttctggattgattagttttgtcataaagctttttcaaaaacttcagcagaagtgctgaagttatttagttcattgtaaaaacttcaggcactaaataagctgaagttttatcctggattaattagtttgtcataaagatttttcaaaaactaagatgctgaagttatttagttcatttgcaaaaacttcagcactaaataagctgaagtttagttttgcaataatgttttttcaaaaactttagaaaagatgctgaaattatttagttcatttgtaaaaacttcatcactaaaaaagctttaagttttgcacaggtaacaggaaggccacgcctgaagttgtaaaaattaaggtatatgttaaataattttaaaaatatgggtataagttaaatgggggcgaccaaatagggcgcctcgtgcaatttctacgtcattatgagcggggctgggtagctcagtccagctcacgtgggctatagtaattgaccggctgggttgggctagcccaccattttgatgcatcttgtaatggtcagcccacgccagtcctatgtgggctgcgggccccacggccgtcccatcatcttttaaaatataattttatatatatttaattctaacctaaaaaaataaatatttaaaagttaaaaaaatcatattggaaaattttcacaaaacttaataactttttatattgttctaatatatcatagtaagcactaaaaagcaaaagacaagattatatctcattcattgaaaatcaaaaactcaaaacaaattattcaagagaacatccatgacgcttatggatatccaactcatcatcttcattaaacacatttgaatctgcttgtgataaggttctcttaacatctttactttcatctatattttgtgtcatatactttttatattttatatattttaaatacatatttttattaggccagggccgacccagcccaaactcagtcaagcctcacgggccaagtgcttattcgggtcgagcttaaaagctttgtttttaaattggctcaaaaaattctagcctaaccctgttaaatcatgggctgaactgggctagcccaacgggcgaaacctatattgatgactctattagtgtcttattctcgatgccttcgtacattttagcatctgtaatttgtatgataagttgttaatgaaacactttgtatacgcataattaggagatttaagggacaatttttaacagattaatatctaataaatcactaacatttgatatattctttcggaaaagtagtaaatgataatattttacacaaacagaatatcgaaatccaaaaaaccaatattctattagaggcagagttagcctataatgcgagtactcgattgaatccagtcatttttgcttaagtatttatattaagaacttcattatatgtgtataaatagttaactttgaatattccttaactaagatgactattatcgatgactatctgtgataaattaagaacccatccatgagaaataaaccaaaatgcagctgaaatggttatttgacaataattaatgaagttttccaatatctttctcaagtaagtaagaataatgaaggttaaaatgagttaagagttcatttattatagagttaattttattcatggtcattgaacttttatatattatccaatagttacttttcttttttttgttacctaaaaatcatttaactttgtgttcattactcaaaagtcactattctttttttttgttacacaaaaattattttactttgctatagttatcacaaaagtcacattttccagattttataatatttttatttgaaaagtctattatgtccttgatattatataaatcttcatatttatgtaatttttttatattatatactaatataattatttaccgtattttattcataactaaaataattcaatattattttatttattatttttataatatattcgtacatttaattttttcataactaatttatttttaatttttaccatacgaaactattctcaggctcgaaattctaaacgtacctcgattactccaaaacatactccaaaccaaatttaaataactttaaaatcttcaattagtcaaccttcactgttaagcaccgaaacgcccctcggttgtccaaaacctgacccgaacatacgtccaagtccaaaatcatcatatgaacctattggaaccgtcaaatcccgattctgaggcgtatcctacaagtgttaaccgaatttaaacttggtctttaaagccaaattaaggacccaagtgttccgatttctacctgaacgcttccaaatcacgaactaaccttttttgcaagtcataaaatagtaaaagcatatatggggaatcttatttaggggaacagggttgtagaaggtaaaacgaccggttgggtcgttacaagtggctaagaacgttaacgtgcgatttgttcatagtaaagttagtgacaagtttaataacgccaccaacatatcttgaaaattaacgttaaggaaaatttaaatatacgaatatattataaaaataataaataaaataatattaaatctttttaattataaataaaatacttaggtaaaaatatattatatagtatataatataaaaggaattgcataaatatgaagatttatataatatcatgggcataatagacttttcaagtaaaaatattataaaatctggaaaatgtgacttttgtgataactagagcaaaggaaagtgacttttgagtaataaacacaaagttaaatgatttttacgtaacaaaaaaagaaagtaacttttggataacaaacacaaaagttcaataaccatggataagattaactctcgtttatgtcaaagtaatctaaagtaaacagaaaattgcatcactcacataggatcataaatgtatctaaaattattgtattttggctgatttgtgtaatcttaaatgatcatcacattaatcagattcatcactatttcaactatataacatagcaacagtcttatggctctgtattcactactgaaaacataggcaagcactaaataatggctcgttactcaatctctttaacaatatttctttctttggcttttgtaattgcccttgatcatattacaccaaaaactgtcgctacgagtcgatccatcgatgaccaacatgtcaatgtcgatgattatggacccccaagagcgagtcatggtccaaaacttggttagagatcaacgattatccccataagagtagggcatggacttggtattggtcttagtacaccaaacaaggagcagaggtcaacgattattcacctacaagaccagaacatgattctacaaataatcatgatgcactaaaacaagttgtgaagatcaacgattactcatccacaagacaaaggcatagatttaatagttgtattggtgcatcaaatgggtcaagggcaacgattccccaaccacaacaccagggatagtcctgatattggtcatggtgatgcaccaccgaaacaaagggtagagattaccgattatctatccacaacacaagcgcgtggatttaccaattttgtaggtgcaccaaaattgttggaggtcaacgactctccgccaacaacacccgggcatagtcctggtattggtcatggtgatccaccaccaaaacaaagggtagagatcaccgattatctatccacaacacaagcgcgtggatttaccaatttttattggtgtaccaaaaggtcggaagtcaacgactctccgccaacaacacctgggcatagtcctggtattggtcatggtgatccaccaccaaaacaaagggtagagatcaccgattatctatccacaacacaagcgcgtggatttaccaattttattggtgcaccgaaaaggtcggaggtcaacgactctccgccaacaacacctgggcatagtcctggtattggtcatggtgatccaccaccaaaacaaagggtagagatcaccgattatctatccacaacacaagcgcgtggatttaccaattttattggtgtaccaaaaaggtcggaagtcaacgactctccgccaacaacacctgggcatagtcctggtattggtcatggtgatccaccaccaaaaccaagagtagatatcactgattatctgtcaacaacacaaaggcatagattcaccaattgtattggtgcaccaaaagggttggggatcaacgatttcccaaccacaacacagggcatagtcctgatattggccatggtgatgcaccagcaaaacaaggggtagagatcaccgatgattatccgtcaataacacaagggcatggaattaccaattgtattagtgcaccaaaagggtcggggtagaaatcaatgattatccaccactgcatcggttaggacatagtcctataattttaattacaaataatagcaatatttgattttgatcacaaaagtttccattaatcttgaattagtgggttgctcataggtaatgaaaagatcataccaactaattaagtaattttgcaagctaaataaatatataaaatgaatcaaactaaacatatattagttttacccatttcagttcaaagtggtttttctttttggggtattatcacttctagcccgcgctaaaaattatttatattcaataaccgaaaaagtgtataattttgtatataacataaagatatatatatatatatatatatatattatatatatatatatatatatatatatatatacaaaatattttttttttttggctttattttgagagcggctataaagtgtcatttttccatcttttctcagggtaagactgaatattttttccaataagaggagaaaagatcaattatacttaagcataacatggattcatttgcttgaaaataaagaaacaataagtttgactaattaatatgagttttcatcatctcatatataactttctgtataaactttccgagaaaaatagtacaacttattacatatttttataaagataaggaaatgattaattattttctacatctcttctcgttgaaaatgaaaataaatgggtcactcaccaagtgaagctttactctaggaatttaagttttatttattgatagtataatttgttttaacactatcaatacaaaaaaaacagtccggtccactaagatccccctaacgtggagtccaggaagaaccggaccataaaggtctatcgtatgtagccttaccgtgcatttctgccagagaaattaacttgtaataataactcatcaacatctgataaattctttttggaaaagcttcaaatgataatatttttcttcaaaaaatcatagtaatttcttttattttgaagtggattacacatgttctatgctactataagatagtccaaatgttcacattattaacaattagatgctcacatttaaaatccaacccttttcacctttaactctctttaattaagttgcatttttcatgcatgcacctctcatagtcacacttttgctcaagaacttcaatctaaaatttctactataaaaatatacacaaatcataaacttttcatcacaaatttattaatttcaatcaaaaaaataacaaatatgggtcgttatatttacgttttcgggttcgtggttttagctctaattattgcaattaattctgttaatggcaatgaatgtccaaataccattattaagcttttgccatgcaaaggttttttaatgggaaaaggtgatattaatgttccttgttgcaatggtgttaagggattaatgaaaatattagccactaatgatgatgatttgaagcttaaacatgtatgtgaatgtctaaagaaagaagctttgtctattggagtaattcaagaaagagctaagcaaattcctcacctttgcaacattaatatttctcttcctattgtccaaatgttgattgcaaaatgtaatatatatatcttctctcctttttaattggtgctcacttttgattttacaaatgattgatcaattaaatgggggattgaattaaatttgggtgggttacaagtcaagcatgtttcaaaatttctttgggtcaagataagtggcctatattaaaaaaagaaaaaaaaaaggaaattttaccttttatattaaaggtatacatcatatttattataaatcaaaattattttaaattattttttttatagctacttttgtattttatagaaaataagtatttattgtatatactatcattgaggtatgaaatacgttatttatgtttttcgtctctcttagaaaactggacatacctatttttaagatgattgttgttactgtattcatgatacatggcgcgaatacatgtgaatacatgcgcgtaagctggactgccatgattttaggcgctttttactgtttgtattcatgaatacaacagcgtgaatacatgtgaatacatgcgtatacaactggaataccctgattttaggcactttttgctggtaaattcaaaaatgggctaaatttaacacccataagtattttgatcttgaactcgtttatatgctcaaaaattaatttgttagatggaatgagtcttttaaatctctttcattaaattttttattcttgattgcttgagcagactaaatacttcaacgcccttaactagagtttcaagctgaacaaatacaagaataccggaatcatgtctttcaagagaccaattcctaatgttaacaaccattcaattcaccacaagaaacctcttgttattgtcccatgaaggtgaagttcatggctatttaatagtttaattactttttattcttcataatttttacataaatagctggtctgattcattatttatatttctggtatacataaattatacacatattatatatagattatacatatattatacgtcattagctagctattttattttaaattgttgagtgggcggctatttatgttaattcttcttattcctcttaatttggactttatgtaaattattttccagctcaatagtactttaataatattggtttgttttggaaaatgcagcattatatcttcatcaagtggaatgcactaagaagcatgtgggcatttcttttagcacacataaagcttgtgttgtgttgaatatgtatgttatgatcaaatgatctatataaaataatcatatttactttatgtaaatccaagtctacaatttaatcaaagcaacataaatgtcttaccaccaaaccggtgcgggatggatacaattcctttattcttaaattagagatctcaagttcgagccctgaaaatggagaaatctaaagaaaatgtgcaatactaaactttgacaaaaatcgactgcaagctgacaaccgatttggtggtcaaaaatcagccaaaaaaactaccaaagtcggtcgatttttcaaaatattttgtttttaaaatatcgatcgatttctgacgtcgattttccccattttattagtagtggtgtttcacctcctttaataggacctgcgcgatgataatattaagaaatttggtgcttaaaatcaataaaagactttttaattccaatgggcggcaagttaatgggtgtcaatccaattctatagctaatgatttgtgtgaatattcaaaaaatgataatattcccttgccaaatccttgattatatgtcttccaatatccactacttgcagtattcaacaatctttagtgctttcacttgattccacacctcaagtttgtttattatcttcttgtttttgtgtttttaataaacaaaaatagcaagttgagattgaagaattgtcaatttgttaaaaacaagcctgaaaaggaaacaagggcacattatacaatctaccgtcaaatctttctataacaatcttatttgttccgaatatttttggatattatagcgaaatgttgttatagagaacatattgtaacgaccctgccagtcgttccgagagttatagctctgtttcccctatttatgcatctttatgtgttggtcagttttattatgtttcatcgggtaggttggtttggtccaaagcggttttggagtggaatgagacacttagtctcttatttaggagtttaatttagaaaagtcaaccggatgttgacttatgagtaaacgatctcggagttgaatttttatgatttcgttagctccgttaggtgatttcggacttaggagcgtgttcgcaatgtaatttggaggtccgtgacaggattaggcttgaattggcgaaattagaaatttggtgatttctggttggtagtgaaaaattaggtatcggggtcggaatagaattccgggagttggagtagatttgtagagtaatttgtaacgtgtgtgcaaaacttgaggttattcggacgaggtttgataggtttcggtgtcgattgcgaaaattgaaagtttaggaacttttaggcttgtatccgaggttgattcaatgttttgatgttgttttgactgttccgaagattcgactaagtttgaatgatattatggatgtgttgatatgtttggttgaggtccgagggcctcgggtgagtttcggaggggggaggtttaatggatcattatatggctttagaagttggcagatttctatcatctaaattgggaattggggtaaaaaaaaaggaggaaaaatggaaaagttcttgagagagtaatttggggatttgagggaccgaataagatcggattttggtgaaattggtatggttagacttgtgagtgaatgagttttctagttttgtgatttctgtcggatttcgagacatgggctcggggccgggtttgggtgaatttcgggatttttgttaaaattaatagtttttcgagtggaattgttcccttggcctatatagattgcattgtatcgcttttggttagattcgagacgtttggaggttgtgtcgagagacaaggtcgtcgcggagtaggattttggcttaattgaggtaagtaacggttccaaacttagttttgggagggttcgaaaccccgagctatgtgttatgtgattagtattgaggtgacgcacatgtaaagtggcaggcatgcaccatgagaattatggcctggttcattccgtggcaccgcttagtgattctttcttgctgatatccgtgtttgtatcatgtgattaagtatatgtgttgtaactcatgctagatatcctgttagggcttcacgccgatactattgagaccctagtggtcgtttcttgttgtcatctcaattgtgtcattgatattctacaatcagccttattcatgcatatcatatcatgtctcagtctcaattgttattaattggcacatcatatcattgtttcgagctagttccatggcattgcgagtccgtgtgtgtggtactggagagtgatgagtgagtgaggtcgagagcctaattatgagtgacagttatgggatcgggttgcacggcacagcggttatgttgatgattgtgatagcacttgggctgtaggagcccctcagttatctgtaaaatactcccggtgagtgcagatgttattgctaagggatgaattttcctggacatgaatttgtccgaagtattgatacatggagatggatttctccgcagggttggattaccctttttcctcggtaccgactgactatatagtcagcatcgagtatgttccgggatagattttcctgggccgggtggccatatgcggtacctagtgattgagcacttgagggtggagtacatggtacatttcatacatactgtgcattgacacgtaacaatttgctgagctttatacttcacattgtccagatttgtatttactttactgcttgagttgaatacttaaatggaaagcatgtctactttactgtaaaatctaattttgttaactgttgaggtttaatccatcactacctattagtccatggtttggacttgttacttactgagttggtatactcacgttacctcctgtacccctgtgtgcagatccaggtatctcaggccacgatagcagctgttgactattccagtcgcggacttcttcgtagatagtgagctagctgcctggaaatcacagtcccgcctttctccttccttatcttccttttagagtattttgactattctcacactatgatgtgttgttatatttcagaacagatatagtactggctcatgacttagtgacacccgatgttggggttttaatttttctgcattttaggttttaagttttatctcttttacgaaattcattttgaaaaaaaaaaaggctattatcaaatttttaaatgaaatgttgaattctttgagggtgtgtcagcttgcctagtttcacgataggcgccatcgcgaccggattggttttgggacgtaacacatatattataacataacatgaaaattagttctggaaaaagcatgacttttatagtgaagtgttgttatataaagatgatgttatatatatatatatattagaggatcgggattgttacacaaatagcctatcaaatttactatttcgtttttgcatgtatatatagattatacaatgattatataaattacatgaattatatatattatatatctgctggttatttttagtttaagaaataaggtggacggttatttgggtttgattcttcttgagaatttcccttagatccacgttggggtagtaattcgaaccgaaactcatttgaccctcataaatccgcccaaggtgtgggctggtcattgactgttcattggttgaacttagcccatcttagtccagcacatcttagctcatctaaagttggccaaattttagcctaaattgattcatgagtaactttgctaaaatatctttaaaataattatgtttttatttgacatgttatatatgaccataacaaagaaaaaagtcttatgtgataattaaacaattgataataaaaatggtacacattaattaaagtttgataagagttggacggcttgtgctataatccaaattttagcacatcttgacctaacctatctcaacctagataacttttgaataggttattgactcgctcatttatttactcggtccattttaaaccgtccaagatcaatccaacccacccatttgacactcttggtgtcccccacactcaccaacccaaaaaaaggaatggtaatcataagctctagaaatattaacaccactccaatattgacagtaaaagagtccatgcatttatataattagcccacaaaataattcacttgaacaccatctatcaaaaaccaacaaagcaaccaaaaaataaatcttgaattacttagaatattttcaaaaatatggggatgaaaaaatcaatgatatggtcactaatggttctaggaattgttggatttgtgactatgcaaaatacttatattattcctatgaaatcattgatttgttatcaagcccaagatttattattaccatgtcaaccatttttattaggttgtaaaaaaaatattacagaagaatgttgtcaaggttctcaaactttggctattcttgtaaaaaatagtacaattaatgatattaaagatttatgtaaatgtcttcaaaaaactgggaattcttcttttattgatgttaaaaaaggaagaaaacttttcaaggtttgtaagatcaagagagttcctattggtccacaagtggattgtgacaggtaattttttattttccattattttctattttatgttgatcctcttcattattttttctttaatcagtaaactactccctccgtttcaaaaagaccggtattattactatttaagaagtctacgaggttgttatttgtattgtgacaagtaattttattctctattattttctattttatgttgattttctttatttttttctttaattagtaaactactcccttcgtttcaaaaagaccggtaccattactatttaagaagtctacgagattgtttttgactatattttttcttaaatattttatgaatatttgaattataaattattataacttataatacttgttatgtagtttttaaaaatataaattttactttcaaaaacttaaagaatttatgtccaaattcatggtcgtactccgaactatgccaatcttttttaaacggaaggagtatctttttggtttcgacagggaacaaaataagaatatagtttcatgttaatttagagtcacttgagtttattatttttttgatataattattcggtatctggaatttactggttcctattaattcgaatttaaaatacataagacatattaaaagagaaacactctctatcaaaaagaaaattcatttataaggggcgaacctgagacctttgtgtaaggacaaaggaattctatccatcttaccacaatcggtacataaccacgcgattttatcatgttttgtgaattagtaattattattctctgtttcaactaagagtttttttaaattaaattgcaattttattatttatttatttattttggatatatgcagtatttgacaatatggactggcaaagaagctttacagattgagatttgggaagaaagtccaccaagctaagaaattattattattacttattgaaatgtattttttttctattaataaacatatttcatttctactcttgctttagcttaagtttggtatattaattgacttaaatatgggtcaaaaagactcttgttacctatgctataaaatgaaataattattattagtatgtcttaaatttccataggtttaagacatctttgtacttcggaaaatactccagaataacatactggaactctagtatattatactggacttccagcataatatactgaagttccaacataatatactggagttccagtatatttattgtagaactccagtataatatattggaagttcatacacgcatgctctaatctccagtatattatgatggaacttcccgcgtgttggagttccagcataatatgttggaagttcatacatagatgcaccgatctccagtatattatgctggaactttccgtgttgcagcaaaattgtggctatttttcaatgactttgcaaacgctggctatttttgaatgatcagtctgaaaactggctagcccgtactatttgtacgaaaatatttgattggtgggtgtttgtgagattcaaacttagaatctttgtcttaatttatcctaatttcaatatatggattaccaaatagactttaaatggtatatgacttaatttgtttaattttgactccagcaatggatttagatagtaaatgtcaataaaatgaaaaaaaatgcaagtggatttatgtttactcaggctaagataagctttaatttttattttcgtacattactcaactttttaaagttttacttttataatgtttatattctagcaggtccggtgttatttttgcatcaggaaaatgatattgtatagcgctctcaaatactatagaaaaatgtatattatacaatttttataaaatgttacgggtactggatataaatagtttctgccgcgagctaaagcgagacattgacggatctggtatttgaagattacgtgttcgagtttgagattctactacaacccatttgatttattgggttcgaaatctattattatactaatttaatgaatttttcaatatatatatacaaggtcggaacaaaaactgctgagttcggatgaaactataagttattgtattagatccggccctgtgctttaaaatcttgattaaatcagagttgaaactgcagacatttgtctatgttcttttacaaatcaaaggttaaaactattaatataacaacattaaaaatagaactttaagttaatcaacaccttctccactccggtttttgtgcgcggcatatacctactttctttattcattcactaataccttccctttttttgtgtgtgggaggggcaactcaatggaacccgaaagaccgagtctaggcaccccaaggtttttggtgacaagacttgaaaatatcagaagtactcttcaaatatattgccgctagtacttcaaatatattgctgcactcgtcggatcctccgtgaatgcagtacttttggaagatctgactaatacctggcgatattttcggaaaatgcgagtaacatagcctaaacatagtatattccagattgtaaaggccattattttagtcacctgtctcataatcttgaaatgggaagtgtaagtgatgaaatactattacaggagccaacagacatgcatagtctagcatgaaacagtaaacatagtaaaatgaacagatataaggtcaagagagaaactactacgagaacagcaattgaacttatatacagtcggaaagtagtcggaatagataattttccgactactttccgactattttggtatcgaaaaagctattttctagtagtgtcgcgagctcagtacgtaagtgtgttaccccatatatatgcatgaaaacggaggacatgtagaacattggcttaacaaagcattcacagctgcagcacacagggcaaagctatgtgtggccaagggtaatcaactaaacacccttcgccgaaaaactatactgcgtataaagtaaaatattacttgtgactgaaaaaaaaagactttaaatacccttgcatagcccaccgacaaagagtgttcaaaaccttaatggaatttgctgacttcgccactggcagcacacaagaaatccaagcacaaacttttcacttcattcatgaaattgatataaacagatagtacacttgacaatcattgtcaatagtgaataaactaagtaggaacaaactatgcaaaacttgagcattctatatgcaaatatatatatagtagtttctctagatgtaatctcaacaaaatttttgtacatccacaaacacagaaaccttgtcgtcgactgggattttacgaaataccaattgtcttgttcagtatccagagtgtaagagacagctgaattgcaaaaattgtatgaagccatgtcctgtctaacatgaacccatatactgtgattccagctctgttgttctcaaagtatgacactgcaacaaatttttccacagccgagatcaataatgtgccatttcattaccatagatgtaaaaggattcaagaaaataaacccaagaaataaaagaaaacaaactcaagttacctagtgcttgtctcttctggtacgatatcgtatgggcatgaactggcaccatatttgtgttgtccaaaactcatctccatctccttcctcgtcagtgtcccaactggaattgataggtatacaacctgagtcgtcgtgctctgagccgtgggagttcattatccatgtcatcaaagctgatcgtagcatgccatttggctgcaagtgatgtcacagcttgtgctttgtgtgtgatctttgccgcactacgcaagcacatgaaaagtccagttaccaaagtaattgagctcaactgcatcgcaacaatcatacaacgtcaaatgcaatgctgctacataatcaagaaaataaataaattctaagtacaaaaagagggtgcatgtgaatgaaggattatatacataccgcaagttcaccagctgtaaagatgtttacagtggagctaggctcagttgtaagaagcaacgcaagaaactgacttatggtaactagtatgagagttgacaaaatgaagactctgaaccggtggctaatgacacgaagatttcttcttattcgcagatgctctatcatgatcgtcgcgacatcagattctctctcgaaaacttgagcaaattcttccaatctaagatctgaaggcagcatattaaccggaataggacacatacaaggaaggaaattgatatccggtatagccaggaacatattaacaatatgcatacaaaggtattgctcaaagcggcattgtacaggtaaggaatttgggttcccctgagaaaaaccaccatatcttgtaaatactctcagcaataaaagaagggagaacaaaagctgacaggatcttcatcgacctctgcacgacaaaaggagaaactgttatacagctgagtataagcaaatgtatacggaaagcagctgagtttactcaaacgaatctctttggtcttgttctgcctaggtacaacctaaaatcagagaaaccaccatatttgcccattctacgaggataaaagaactatcacgacactccccccccccccccccccccccccccccccccccccccccccccccccgtaaaaagcaaggcaagcacttcaatccatgaagcagatgtgtatcgaggccagcatagtacccgtgcaaaattcatgatttgggttaaaagggtctaaataaatgtttggttctttgacatagaaaacgccaacataggcgtttgaagtgttctccgtcgctagtagcatcagcagtatttgcccgaagctaaaaatactgacatttcttaatccacttaaaactgatgattctccaatgattatcaaacagactcaaacttttattacgaatgcaaaacaggaaaatattagcttaaaacataagaaacatttataaaataatatgcactgatcagttctttctgcttatgagagaactaaacagtattgaccacatcatttaaaagcttaagctattagaaagaaaacagttttatttattaaatcatatcttcaacacgtctcctggtgcggtcatgattctttcaacaggacaagtacctttaagttcaatttaattaagggtggagtgagattgaactcaagacatctgcttgacaccacattgaattatataaacacatcatttaaaagcttacgctattagatagtagacatgtttatttacttaattatatctttaacaagaagaatgggagccttggcgtaactattaaagttgttgccatgtgacgaaaaggccaaggttcgagctgtggaaacaacctattgtagaaatgcagggtaaggctgcgtgcaattggcccttgtcgcctggccctttcctgtaccccgtaccccatgtatagcggagcttagtccaccaggtcgcccttttcatatattcaacaagaacctaggaactcaatatacaactgatcaaacttgtgaatcttgaaatcatcagcaaagaggaacaattaacacattttgaaccaatcccaaattcagtaaagttcaattattttctaaatctaactaaacaaaacaacaacaacaacaacaaccccagtaaaatcccaccagtggggtctgctacccggagggggtagagaggctgtttccgggacaccctcgactcagacataatagatgtgtgataactaaatggaaaagcagtaacacaaatattatgcaaaagtgtgaaataagacataatcaccaccagtgctagacaaaacattatcatactgtcgatacaaagagggaaaaaacataacaacaaatctggaaaaagaagagtaacaagaaaagggggcaaacaaacttacatgtagctgctgagtatattcttgttgaaccttttcactatcttcatacaatttatcaagaaacaaaaatcttctaatcccatatttcctagaaaaagaagaaagactaacaaaagacaaagttgcaaaaagtgaaagagaaacttgaacaacagcatcaaatggcctttgatgcatagaatcacagctttcacaggcaaacacaaaatgagaaactaatggaaccccaattgttaaaattaaaaaaaatgaccaagaaagaccagctctccatatatttgattgatcaagaaaaacccaagtaagagctgatttaattttcttgatttctactgaattttcatggattgaatatcctgaagaaagtgcttctttgctagtagtagtttgtaataatcctgtttcaccttcttccattttttctctcttgagctataaaattcaaatcaaatgaacatagaaaaatttcaagatttcaatttgtagagacaatttaagctgacttgattaatatgttttaatttccccaagtgggaattttgtaccaagatcaagcctttcagatgtgacttgaaccacaatctatatatatatatataattaagtaaataaaaaggttgacacagatggcaaataaaaatggtagctgatactgtttgatgttgacaaagatcaattttttaagaaaagaagaaaaagcaaaacaagattagtcatgctttagattatgataagtagatatctattattatcatagtgttgatatacaagattctcgaccgaggccgattcaaaatctaaagtttatgtgtttatatgagttcaaccgaatcataactttttgcacagagtatacctatatatattacttaaaacttaataatatttcaatatatattagatctgaatccataatttaataataatgagtttaatgttgagaatcttaaaagttgaactcattaaatttaaatcatgaatctgtctccatattcaatatttaagattttgggcattgaactgattataagggttcatatctactactttttttttacaaatctaatagttttttacttataaattatactctgtgtcgaaaattataattttaattgaaaaaaataaaaaaagaaaggaaaaaaaaggtgggaaatcacaggttgcctggtgaagtggaaggtgagatttgagtaactggcgcgtgaagcttttttggaatatgaaaagtgaagggacaccatttttttaggaaagtgatgggagaagtataaggtattacgtggttggccacctttgtgtctgctacgagttagggcgagttagggctgttcatgtgaaacactcagcttaaagtttttaaattatttgatattcaactgttgattggactaacttgaattcgtatccatcatggatggttattacgtgtaggtagatgcgggtaaaaatagcacgggctagacaattttcggattgatcattgaaaaatagctagcgtttgtaaagttattcaaaaatagtcactattttactgtaacacggaaagttccagcataatatactggagataagtgcacctgtgtgttaacttccagcatattatgttgaactccaacacgtgaaaagttccagcttaatatactgtagaatggagcatctgtgtatgaatttccagcatattattattatactttagaatggagcatctgtgtatgacttatcgtccaagtataaataaaaaaaaggtctaaagaaaagaaagtaccaaacaaatagaaacttcttcacaaaatgggtgctatgagaagggaaaatattgttaatttcctgtatttgtacaacaattatgaataaaataaataacttaaaagaaatgtaaatgaaataagaaaaccaattcgagcccactgaattcacagtgtttccttaaggaatttaatcccctcctagtacccaaggttatggattatttcctccaggatagaacgaattacacactggtgtagtggtacttcaaacccagtgtttcagcgaacacaaagttcgatagcaaatcacacttactgttgcttttctttgaagaaaaactatgcaaaaggaaggagaagaactcagaaattagtatgtaaaatctgagagaataggcttgtatttatagccaaagttgggctgaaatctgaagaggctgtttttgcaaaacgcccatagaatattaatattttattattaaataaatatttaataatatttctgttaatattaacaaataaatttggtccaaaattaatcaatcgatcatttgaccgaagccgaagccgagccgagcgagcgacgacgacgacggcgcgaggcttgccttcttctcaactctttaagagctaaaagaagagcaactgcttatatacccatcaaaatcttttcctcttccgatatgggataatcaaggagggaatctcaaatattactcaaatattttatttttccctccatttctcattcaccctattttaagcttatcaaggcttaaaaactcaacaaatatttgattaagcatgtttcgcccaacaataccactttttccgtttgcctttttgtgtcgagggcacaactaaaatatttaaggggtcctatatatatgtgtgtgtatatatgtatgtatgtatgtatgtatgtatgtatatagggctctaatttaggatctttgactaggagtaaaagaaccttatagaattaaaagagcaacccgattcactaaacttctgttacgcgagatttcgagaaagtctaaatttattgacttaattaatttaaatccatgcaaggttggactattaaatggggtggagtacttcttatcttagaggttctttattctcgaaaatggataatcagtcatagtagaaagtagatatcgaattttaaattagtgagcatttatgaagtatcaataggttcactacttttacaacaattaggtaacaacgtaatataaaaacaattttttatatcatagtatataagctctcaagtttgagttttttttaatgcattgtactcttagtgtattttatatttaaaaaaaaaaaggagaaagggacaaataataattaaaatgttaacgatgaaaaaaggtatacttgcctaaacaaataaaagtagcaataatttaaaactgtggtctcctgtaagcatttttagctcaaagagcatttcaattatttttgcttcgcttatgtccaaagtagccttttggccatacaaatttttttacttttttccaaaaaaaattatatatttttttttcgaaatcagcttttgaccaggaaattttgaattttcacttcaagatgaattttgaaatttttcgaaaatttgaaaaactccaaaaggtagttttttacaattttcactttaaatgactcaaaaattcaaaaaacatctcaaaattgtacccacgcccaagcacaactctaactttcaaatatcaatttcacatgaattctttttcaccttttttcgaattttacaattctttatgtccaaatgcccacttaatttgtccatttatctttacccaaaaatcactcttattatactattgtttatgttttactctcttcggtccactttaattgattttttgaccgttttcacatatattaagaaatttatattttaatataattaacaatagaactgaccatattaatcttaatttgttaattcgaaatacaacaaatatccatagactctttactacacggacaacttttgaagaaaaaaaagttaaatccttcttaatatctgaaaaagtcaaatattatatacccacaaaaaatacaaagaaaatcaattaaattggacggaaagagtatgattgaggcttattagtttaataatgctctagacaattataggaaaaaacagtataatgaaaaggttgtaacgttacaatcaagaagggtaggcaaagccatgatattgacaatgtgaatgcagacaatatacatctcgtctctccttataattgcaataaactttattgatttatattcgtaattctatcgtattttatttaatttaatagcttaaaatttattatttgtacatatttaataattttttggacaaaagtactaaatataagcgaaagctataggctaatctggcaagatgtcatggtgtagcagtaatagattatttatttaattaatatgggttgtcgtggagtggtaagtactccttcatccttaaccagaggtctcgagttcgagtctttgggtatagtcgagccctaatataaatatcggacactagatggaaagcaaaaaaatagattatgtatttgttttttcttcttccaagaggccttataccgttaattagaggtcccgcgttcgaaaaaagttttatgcaaaaacgatgtttttaatgggcttttatgttgagcaaatccttattagtcatattgcaatataaatatcaaacaccatatggaaaactagaaagaaaaaagaatgactaagcagggacggagagagagtgttgcttacggttttggacgaacccggtagctttttaatggctaatgagctataagttcggttataaattcggaacccataaattttaaaaatcttgactccgccactgtcactaagagacgaccgatcaataacctatagaacttatagttgtcaataatatacgtatccattcgtctcaacattaatcatatttgttttttaacaatttaagataagttgacaatctttatgattttcaacatcatatatacttgtaaaagtattaatcaataaaaaatatacaacttattcgtgtattatataaataaacacgatacataaaagcctaaattaaatggtttcactatttctttttcttattattcactcgatagttgcattcaacatgaagatcaagttgatgttattttattttattttttacgattttgacagaacttaatagctttgattgaagattgtattctattaagatatttattaaaaatgtataagtgtttaattgcatacttgtagtttgtaactaaaacgaattgttattttaaagataagttaaaaacctttaaactttaaatttcggctctgcctatactaatgtaaacattatgaagagatggatcgaagatttatatttgattggtctaactttagtctcttatcatgacttactaaacttttaaaattataggttcaaaattatattctttttgaaattttcgtaattttcacgtatatatctatattccgtgccgaaaacaataccgtttagagtgggatctgaactgttaatttcaattgtagaggtgcacccaataataattgcactataatagtctttgagcatgggctcacgcacatatatttaaataattttgacgaaatataacattgtgatacatgatttagaaagaggagtatgagttcacgtgaactcatctcctctccttggatacgtctctggcgacaagtatgcattaatttcttcgaacaaactcagcataatctcacatagtgaaatttgaaaaagataaagtatatgtagaccttacccctatattgtaacgattgtatgctaagacaacgacaaggtggaacatctaggtggatatttagcattagcctagttggtttcttcttttgttaaaaggtgagctattgttttctcttgtctcaagttatgccgaaccactggattctccaactcgaggagtagggttttagcaaataatcctatatgactcgttcaagagttcgctattgctaaaacaattaacactgaaagttaactggtttaattattaagtactagtttaaacttgtttatagtattcgagacttttgattattttcaggtaatcacaaatagtagggtgacgcttgctcaaatggcagaacaactccacctagtggcagagtcaagatttttttctatactaagaggtttcaaatataaagaagtaaatacgcgaacaaattaaagagatccaacatctactaaatacataaaaataacttaacttttatgttgtctgtacaatataatttcctaacaaaaaaagttcctgcgaaaaaggtaggtgggaataccgttgagcagaggcggtctatatgtaacattaaggggtcaccgaccttacaaatttcgacagaaatcttgtctataagatagcaccccgaacactaaaaagtctttaaaggataatggttaagcagaatagtgatagtctcgtcatgctaaaatcttgggtctacctctgcgattgagatatccttctatgctaaaatcttgacctcactcttttattatggatactcaatcgtaaagtcagtggacctcattttatttttataagcccacagggtatgaagtacaacaagggtgtgtttggttgaattaaatcttttgaaaaatattttctttatgcactcattttcctccaattaaaggaaaatgttttccttatcaagagaaaggaaactatttttcaaaattccttctcaacctttcccatcctaccccacctcacccctctccaaaaaggctattttttttttcaaatttcaatttttcgttaccacccaatctattaacccccacctcaccctcaaaaaaatcattttttttactttattctttttgcaatttcaaatttctgtttttttgttttctgcatcccccaaacccccaaccccaaccccctccccacagcccctcctcccacccacacaaaatttttgtttttttttgttactcttttttgtaattttaattttctatttttttgccccattctctcccccccccccccaaaaaaatatttttaatatatttttcgtttttagtttttttatttttcagtttaaaggttcaaaattttacaagttccaaagttatgaattcggaggtttatgtgtttggaagtttacgggtttagaaattataaagttttggggttcgaaatttcgcggtttcgaaagtttagtggttcggaagtttatgaaattgtggattcgaaaggttgttggttcgaaagcttatggcttcatgtttattatatctaaattacttatgaatactcttgagaagtcatttttcttaatttgcttaccaaacaccaaaaaaagaataagattactacttgttttccaagaaaatattttacacgaaaaatattttccattataccaaacacagcctaagatctcatttgtttttcttaagcaggcatttggacataagaattataaaatgctaaaaaatgatgaaaaaatttttaagtaaaaatggtatttgaaatttagagtgtgtgtttagacataaatttcagtttgggttatttttggagttacaatgagtaatttgacttttgagtgaaaattttgaaaaataattttttaaattttcgaaaattttcaaaatgcatcttcaagtgaaaattgaaaattttatgaacaaatgctgatttcgaaaaaaagtaaagaattttgcaaaaaaaggaaaaaaaatttatgtccaaacgggctctaagattaagtcgtctgaatctgaatacgtatttgaatatcaaatgtggatcaagattaagacgtctgaatctgaatattaaatgattaagacagtttgatttttaaatatatgcatatatagattttttctttatttaaaaatcgataaacataaattcaaataaaatactaattagtctaatattctatcaaataaaatatatacatacatacatacacacacacatatatatatatatatgtgtgtgtgtgtgtgtgtgtgttatggtagttagtggcggtgatgattgacgaaagtgcttgtaagtgctaactagaggcaatggttggtggtgattttggttgataatggtggttatgggtagtaggtagtagtgattggtagcggtagggattatggttaaagatggcggtggtgagtggtgatagttaataatggtgggtggaggtggtggttgctatgatcgaggaaggtgatggtggatggtggtaatttataatggtgggcggttccggctatggttattgatggtgctgaggtggttggtggtggtagttgaggtggataagtgtgtggttatggttgaggatgatggtggtcaaaggcggatccaggatttagaggtttcgggtagtcatattacaatttacattgtctaatagggtataaacttaatcattttggtatattcgggtttcatttccggttaatcgtctttggagttaatataaacaaattgatcgagcaaaaagattatgttataattatgataacttgaaaaaaagagcataaaattcaactggattatgcattttgtacaagaaaaaagcctcgttattacgttatatttagatacttaaggcaaaaacttattctaatgagtagtctaaatattaagtaagttttatggactttttcagtttatatttttataaaatcaacccactcgatattatatacaattgtcctactttagagcaatctaacaaaaaattaaacttttatcattgattaaaacaataacttattcaaggattctttttttaacttttttttttgggttctatgaatagattttcagagttggtgtcctggagaaaacaattatttctatatctattgataaatcacggaggagttaggaaagtgcaacaatggagatttctttgaataaaaataaactaataacatcaaagaaaaagtcaataggacatattaataaataaaaaagagcaattatgtaaaagaaaaagaagaaacaaaggaggacaagtgcttctttcggagttaaacttccatttgtccatatttcgagaaaaagatgggcgaggatcaattagttagctaacgaagttgatgttgaagtagaaagaaggctgcaattgtcttaaatgcaccaaaaaaaactttttaaaaagtgagctaagctaaattcgaccccccaccattttggtgaaagtgaaaatgcgttgccaatggcgccttgagccctttgttactgagggtgccacttaaagtatttgtatatatttcttctatatatatattataataatatatatatatatatatatatatatatatgcatgtatatatactattgcataatttcggccaaagcttgcgggtggcgtaccaccccgtcccttacacgtagatccaccgctgatggtgatggggatggtggtagtggtggcggctattattgaggatggtagtggtagttgataatggttggtggggggggggggggggaggaggcagttagtattgaatgttgatgacagtatcttaatgaaattaagtctttgttatagatctttatcataccgatctattcagactcattaagtggttgtgaagtaaaaaaaataacacacttaatgattaagatttgaatgattaatttagattttaaaaacaaacacacttaatatcttaaatttaaatgattaaaattcagactaccattaagtacaaacaaatgaggcctaatagcctttaaagtggatgaccataaatttttatcttgtttgcctatgggtaaaacttccaagtttaacaagccacatgtgtcactcttcacttgtctcatattcaatgcttttaacttttgaccttaaaattttacaatatggtaagttaaagaccataaaaaatgtatcacatttttgtaattttttggtcagcatgccccactttaaaatgataagtccaactgattatatttgggcgaagtgtatcagtagctatttttaagtctgctatttaaattatatcaataatttataatgtatttaaagattaatcaattcattcaaatttcaggactaagtatcatgaatccatgagctgttaatttgaaattaaggagcaagtgtcctaaatttctaaactgctaatttgaaattcaggactaagtgtcatgaatttctgaactgctaattcaaaattcagaacacaagattcggatttctggacacaatataatgtcgtgaagtttgaacaaattaactaatctttaaatacgttataaactgtgaacatatttttaactagcccactagccctaactttctgataatccatcaaactttgcggactataactcaaactttccttttgctacccaacgaaaggggcttttgcatcaatattcgttttttggtcatgttttaacttatatccgctttgcaaaaaaaattgcaagcgcacccacttttagcataaatttcaggcttacgggcatgaagtagcaaaggcaatcacacaaaacttaagcattctaggctttttcaaatacttcagcagaagtgctgaaattattagttcatttgtaaaatcttcagcaataaataagctgaagttttgtcctggattaattagttttgtcataaagctttttcaataacttcatcagaagatgctgaagttatttagttcatttgtaaaaacttcagcactaaataagctgaagttttgtcctgaattaattagttttgtcatgaagctttttcaaaaagctcagtgctgaagttatttagttcgttttcaaaattttcagcagaagatgctgaagttattaagttcatttgtaaaaacttcagcactagataagctgaagttttgtccgggattcattagttttgcaataaagctttttcaaaaacttcagcagaagatgctgaagttatttagttcatttgtaaaagcttcagcactaaatatgctgaagttttgcacaagtatcaggaaagcggcgcctgaagttgtaaaaattagggtatatattaaataattttaaaaatatggatataaattaaataggggcaaccaaatagggcaatccgcgcaattttaaccgaccaaaagaacatactgaaccaaaattacagaaaatgacaatagtccaagcccaccaaatagaaaactaacaacttttccaactcctgaattttcttttctttaccttccctcgccaaaattataacacgaatttgtattaaaattttaacaattcatcagaatttttgtaagtcaattcttagcttagaatttttgttagtcaaattctgataatccattaaaaattgtggctagttctaaccagtaagttattttacaaaatttaaataaacggatcaaaacttgaatagtggcacaaaaatggcttatttctgcaaatcaccccaaaagatatagtgaaaatagcacggactagttattttttggattggtaatgaaaaatagccaacatttacaaaattattgaaaaatagctattgtttttgttaaacaaggaaagttccagcatactatgcgggattatggagctctgtgtataaacttccagcaattatgatgacctcggcacacggaaaaaaatccgaactccagcatattatgctggcatttttgaatttttaaaggtgttttgttcagattttatatttaaataaaaatatgcctaaattttaattactttgaaaccatgactatttttaattaccagtggtaaatatgactatttttgattttcccaaaaatatagtgaaccaatattacagtaaatgaaaatcgcagtccttaaaaatatctattttgcaaataacgacaaagtattttgatacttttcaaaaccatccctagcttttccaattccattgcacttttgtccattttccagtttgacacagctattggtttctcagaaaaaaactaacgactttctttaccttccctggccgacttatagtattaggtcgatttactgggaaggcaaaaggttcaacaatggcgatttatctttcatctatggcttttggagccccagttccttcattttcttatttcaaatcaagaaatcttgaaaacccatcatttttatgcatttctcagactcctttttgtttcaattctcttttttcacttcaaaattcttatggatcttcacaacgttatgtgtcaaggtaaattatactataaagttattgtctttatttaaatttagctggaaaaaaaaagaattttaccatctttcttgtttttggtagtcttagtagcacgcatgttccttcttattattgatttataatgtgttatgtgattttgtttgcctcaaatattgtattctctgttgctattatttggtactacttattcttttatctcttccttccttcttgttttcctcttctccttgccctttctgagccgagcggagagtctattgcaaacagtctctctatctgcatcaggtgtagtagtcagagtacaaactaacttaccagaccccacctgttgggaacatactggtttgttattgttgttgtttcttgtatttgatattggcaattgggaaaaagaaggaaatagagaatagtaaaatttgatatttttgttggatcttcttcatttctagaggatgatttagcatgtattttaatcagtttgtatttattagtattaatttgggagttgggtattaccagcaaaactattgagggttgggccttgcaaaagcttagtagtaactgaatttttctctaatttacatgttgtgtatttatgtctcaagtgttaaattgtctagtaatatcggaaatgaaatggatataatggcatgagttgagcttaaatggtgatatggttagtgaggattcatatagctgactccaacgtgtttcggggatgaagcgtagttgttgtattggaataaaatggatccaaatagagcagagaatatagtggattatatagctaatccaacctaatactgggttgaatgtcgaggcatagttggttgattgattgctttgcggttcatattgtagagaattcgctggttgattgatgtttcggtagaagtttagtggaaaagaaaggttgatttgtttaagttgtcttttggttgttcaattgtatgcagaaaaccatgcagggttcgagcaacgttgttacaagagaatgaagaggaagtggttgtggagaaatcttttgcacctaagagttttccgaccaaaatggagggggaagtaatggagagccaccagatgattcatcccctaacggtttggagaaatgggttgtaaaggttgagcagtctataaatatctttctcacggtaggtattggattttctgaatctcgcttagtatcatatttcatgagaactatgtatttcaagaatatttttcagcgcataggatttagtcctaagtagcttttgtacattctaattggctaagaatttgtctgattgtgatcaaattataataacaacaacaacaacaaacccagtcatttcccacagtggggtctgaggaggataaaatgtacgtagccttacccctgccctggaaggacagagaggctgtttccgatagactctctggagaacagatgaaaaaagtaatggcattgtgatcaaattatgctctgataatttcaggattcggtgataaagattcttgacactttgtatcacgaccgaaactatgcaaggttttcgtgctggaaacaattgcaagagttccttattttggtaaacactatgtttcacgctgctgattcttttgtagtactagaccactttcatccttctgaatttaggaatattttaattctactattttctttaggcttgaacatatgtgtgcacggtattgacatgtggattatcatgtattcatgacagcatttatatctgttcttcacatgtatgagagctttggttggtggagaagagcagattatctgaaggtgcattttgctgagagctggaatgagatgcaccatttactcattatggaagtaacgctctcgcttctagtttcttgatttccttccaacaaatacccaagtttatttttcctctcttccttctaatgtactactactgataagcatctgtcttgccaaagtcgttagtgcttctacgtatattttttcattaataagcatggtttattcagcaagttttacgatatgattggctcgatcttacatttttcacgtgcggatttaaactttttgttagagaaatgtattatttcatatgggatcttctgagtgtttcgtgctttaaagtaatggaccaacttattgtgcatcacaaagccttatttacttgaattgaaaataattcatagttatatttctctgtcctgaaataattgttgttcaactgcaggaattaggaggaaatgcctggtggtttgaccgattccttgcgcagcatgttgcagtattctattatttcatgacagttttaatgtatgctttgagcccaagaatggcatgtaagttgtaatattaggatctaacgttcgcgtctctagagcttttctctatctcctttcagtttttcatagctttttattgtttaaaagagtatggttatggatgtcgataatagctggaatattcatcattatcttatagaccaattttaatattccaggaaaagtgttttagcctttttaccttatcaaaaactatgtagcatcttttacctatcttgcttctttacagaattgggagatgaaactactgctttcggcatttttccgtgcacgtgttctttgtctagttttaaatcctttgatttatatacccgaaagtgacaatagtgattggtcatgattttatgtttgacacgacccttcactgatacagtttggtggtgcttcaattcttgcagatcatttctctgaatgcgtggagaaccacgcatacgagacttacgacaaattcatcaaggatcaaggaggtattattttacaaacagttgcatattttgaacagcaaagtggaattgccagaatttgacatggtagtttcctttagtttgtttggctctctctcaaggatagcactatgtttgaaaaggaacaaggacctcgggaagagggaagatggaagaataggcatatatttctagtcaattccttttctgggatagtttaatgctattagatttttaacctcaaatggtagtaatattcagtgttaatgcttctgcagatgaattaaagaaattgcccgctccaaagattgccgtgagctactacacgggaggtgacttgtacttgtttggtaagtgttacagcggtacttaataaacttatgaccaaataatttccacctggttcagtaatctaaaccatcttgtgattgcttcagatgaatttcaaacttcacgagagcctaatactcgaagaccaaagataggtaaagtcacctcaatgatattctatcatgtcgctgtttaaccctctttcttcctgaacttcgatattgagcttggtttagattatttaataagatgacttttgcataaatacgcttcatatcctgatccctggccaatctattgagatgttccattagacgtctttgttaattttcagtgatatttttgtcgaaaactgaagggtacaaagtgttgttaacacttatatttataattctctagcggtggtaacatttcgtgcctccctatcttatagctgagatatatgtttatctggagaaaggaacgctgtttcgttacttttgataaatctttttacacaagtgaaagagtacagttttgattgaactcatgtttcctatttagataatctgtacgacgtattcatgaatattagagatgacgaagcagagcattgtaagacaatgaaagcctgtcaaacgcatgggagccttcgctctccacacacagatccttgtgatgaccctgaagataattcagggtgtcccgtgcctcaggctgattgtgtaggtatcgtggattgtataaagaaatctgtcgccgatcctcaagtcaccagaaggtagagcaagaaaaatgacaaccaactaaactatacttgtatatactagtatagcaatacaaagatatagatccatgttgtatctttttgtctgaggtagagcatgtcaaaatgcccaaagatgggtaagaatttggttgttttctgctttcatatgtactgaatgtattacatatataatcttttggaaagtttcaacaatttagtctttacttgttatgtcaaccactagataatttgtaccctgatcaagtttttagttgttttcctttatgttgatctataatacaagagcagaatgtgttaccccatgaactggttacacacacacatgacacatcacatataaacacacagacacacacatgtcagtcgcaacagcggagacatgatttctgctaaggggttcaaaaagagaaagtttaaaaatttaaaaagatttggccagtgggaattgaaccagtccccttggccactaagctatacgtttgagctatttttaagggattcgaagtatactatatagagataaaagatagattgtgtcttatatgtatagtgcaattttccgggcaaggggttcgaatccccttccgccccctaaatccgccccctggccggtcggtcgtcctttagcccgtgataagcttagctatggagtgagtgtacaccatcatgtcgagactctctttcaaagtgagataccggctttcacgagggaaagaaattatgttacttgccactttttgcagaaatggagatatgaattgatatatttattaaatttgtgagacgaggcatgaaaatgcagtttctgccttgaaatgatccaggaaaatttggtgtccaattatagattcgaaccaataattggtcatcctaaagagtatatgtgtcttggcattacacaactaagatccgattatgtgaatatgacactgatatatagacaaagggaatgtttccgccggaggggtttgtctccatggaaaaagtattcactactgcttacagcgcctttattcactcgtcttgctactgcggaactgttcaacggaaacgtggagtcgaacgtcggttcttttgctccttgctggcggagcggcataccggaagaaattggaagatcgacgacggaacgaagaacgttattttacgacaacaacacaacaaagaagaattctatggggcttccctgtcgagaattaaaagtttttctcttagagaggcatataattagcttgctcgtactttaactaatttacaaagtatttactaccttttacaaataccgaccgacacacattgtatggaaggaagatatttcctagagagagtgtagctcaaaattctaagaacccttttcgacacaaaaaaaagattcactttttttccaaaagaattttacttttttcgaactcaatatttagctataaaatttttaattttcgcttaaacagaatccctttattccatattatttgattcaataatatcttcttcactcatattgtcaggtcatgagtaagtgtacttaatggttgctttaaagccacatatgtaagcctaaaaagttgggtcaagaagaggtattttgtttttttctctttatttttccaatattttattggttgggtacattgaatatactgatcatattctgatttctgactatatttataaacttacttttaattgtatgatcctatttttttttatacatatgagatttatttttacatataagaaatcttttttatacgtacgaaatttaaaaagattaacttttaaaattcaaaattataaaaaggacatgatatacaaataacgttaaaaataggtttgttggccatgtcccatgttacatgcagtggcgaatctacatagatacttatgggtgcttgatcatccattatttttaaccggatagtaaatttgcatagacaattataaaatagttagattaatatagagtgagtacccataactaaaatcttttttctcttctttcgaattttatcgataagtgtccgtcactttaaaattctagatccgccactgattacgtgacccataacatttcagttctttattcgtccacgtttattagctactagttccgagaaatgaataaagaatcagccaatcatttataccaatggttttccatttgaattcttggaattagaatttagtgaattttaatttaaactatcaatatactctctcgatcattttacttagtacattttgactttttacgttctttaaaaaataataaatgaaatgcatattttattgaatttgaaaaaataattaaaataactaataaatactgcaatataacagagaaaaaaaattatcttctcttaatatgagtaaagtgacaaataaaaataaaaatatacttttaatatatatgccaaaaaaaagtgaacggagtaatatttaaatactccatacataacagttaatttacaaacatatttatcctgattgtctctttttctctaaggtagagcatatataatcgccacctctttgcaatttctccttttaataaatttttgtcgtaacttaatcaagtattatttaatattcccttcgggctacgataagcgatcgaggcaagaggctcttcatctctaagaagattgtgttcaggatttgataatctaagccttgcttattctggtcggtgtttgtcttttaattttggtttaaaataagtaatttatataattaagaaaaaatctaatttatcgttttcaaaattaaccttacatacatatttctaaaaaaccttttactccttacattaattatactgcaacatttaattaatggtagtttagtctcactaactattttgtctagaatttagtatttcttaatggggtgcccaaggtaaattgatcacttattgtgtaccggagggaattccataataagtgatcagtttatctttttattttagtccaaaataagtgtctatttatataataaaaaaaatccaatttattttttcaaaattaactttatgtacgtatccctaaaaagtcttttactcctcatatttaattatactgcaacatataattaagggtatcgcacatagcgatagcttagtgcaccgggttaccctactcacacttattattttttatctagaacttaatatttgcttaataaatatattcaaataaatttatcacttattatagactggagcaaatattttaatattaatctttaattatgaataactcaaaatacgtaatctagccgccaccagatttgaccctttttgttcggtattgcttgattcaaacagatattcttcttgtcgaaaataacattttctgccggtcttctttttggtgggttcttttttttgttttcatctcgtattttatatttagctcgcaattggacgtagatttgattggaactttaaaaaataatttttgaatttgtgttaaaaatattttttaaaacttgaagttatatttgaatatgtattttaattgaaaaaacattgatattttataagtggaagagaaatattcaccaaaaaaattaaatttttaagaacttgaaaacttttgggaaagtttcgatccttgtgaaacaaagaggtaacagagaaagagacggatgaccgtaagaagatcataataagataaataatctggagtagatgtctagatcagggtgccggcatgacatatatagcatgtgtatcgtgattcgagaggtcttttttcaaaattatcgaacataatgatttatcggcttgaggcttattttttggattttagcacccaacaagtctgtttatacaaacgatctaggcttgtattcagagttttcctagggttggtaaggcaaaatgaggtcaccctagccaattgagtaatttcttttctcccaaaacatgatcatattttaaaaacaaataatattttcaagtttttttgaaaaataaagccaaaattatggctcaatggaagcttatatatattagggttttgactaatttaattcttcgttgcataaagttttgtaaaaagaaaatgttatttaccagaacttttttcacacgtaaagctcgaatatagaacctctggttaaatataaagaaatattatttatcccatcacaactttgtgatggcataagatcatattcctgtgatagttgatggcttgatgcaccaaattaatcaatacgtttgcagtataggtgtcaaggggccgggccgggtcggtcaagggtagaggaacggttccaggctttgccggtgcaaaatatactgtaacggtccggacctaatgggttggttcggtttttttttgtataacaatcataatttctaaaattaaacaaaaaatcaaaaaataaccattgaaccggtccgagccggttcggttaacctgttccaatatgacttgaccataacggtcgttaggggtgttcgtggttcggtttgggttggtttttccctaaaaagaaactaaaccaagtaagtcgatttttcaaatattggaaccaaaccaaaccaattaagtcgttttttttatcgattcggtttttgtcggtttttcgattttttcgattatttattggttttttcttaaatatgagacatacactaccaaatgcgtattccggcaactacattttcaatgtaacactgtcaaatcaattgctctttgagaaatctatcgttcatcaagatatattaatgataattgactcaaatagtgataaataatttaagtactcaattaaaaattaattatttttaacatgaaataaattcttgtatttagcaaaagaaactaccaatcaaactagaagacaaagaattagattattataatagcaaagaactagactaaaaaaataaatggctaatatgtaccataaaattttagaaactttatataagaatatacatatatatatatataggtgcaatataaatttaaatagttacttttatagtcggtttggttcgaattttcagttattttttttttaaaaccaaaactaaaccaaatttgatcggtttttaaaatttaaaaccaaaaccaaaccaaacctaaaaagtatcaattttttgatcggttttgttcgatttttcggacttttatgagcacccctaataatcgtactagaccgattaaccggtgccaaaaattctacccgacatagtacgatctccatcccaacccaaccttgcccggccctttaccaccgatgcggtccggtccggtttaaaatcggtgtaggccggtccggaaacgagcgccagcccggcctgtttgacagctatagcttgcgggctacgttagcaggtaccttttttcagggatcttacaaaagaatccaaaatgtaatgacaagaaacaataaagacaaaacaaaaagacagaaatgtaagtagttttgtgaaaaagtgaacagaaaatcaatcagccaatcccacatctgatgtcgtggattagttactaaatgctctctttctagccttgttttaagtgaaaattaaatctaatctaatctttttaaaataggattaacacttttaacaccttgtttggaaggttgttacccattgtattttatgatattgttactttaaatacgatatttgtttttattgttacttaaattttattgtatagtatcattaaatccgtcgttaaataatgacgaaatatgtcactttatgtaatgactgatttggtatgatcgcgtcgctaccttgtctttttatctcaatctcacccttcattgttataaaaattttatcatgtatcataatttttctttataatattgcaaatttattcttcatattgctggcgtgtgatatcatgaaacgacacaatttatccaaatattgtatttatcaaacgatagaccacaataaaatacagtacgatcagtggtggactcagaattttgtgcaagtgggtttaatctagaaatatataactttggtcgtaaaataatagttgtcaagtgagttcaaataaaatatttatacaaaatttacacagttttaatcctaatttatacatatacacaatattattttttaatgaagcgggtttagttgaacttactagtcaccatataagtccgtcaccaaatacaatacgatatttataaaataatacgtaataaccgtccaaaacaagttgtaaggcaatggaagtaaccacttgtccactatcactaccttttttatgcaacgtaacaagggtgaacatcaaaaactgtattgaattaaaaatgtgggtttgtccgcaacatgttgtcaacctatgaatttataataaaagcttattcactatttataccaatttaataaatataaaatatgtctttcatacacacattcatactaacgtattcatagaggcaaaggcgtagctatacattaaaggtggacaattgaacagtctttgtcgaaaaattttactatataatcaaaattatttttcatatacagttaaacatctctataatagaatccatatataataatacttcactataaagctaaatttttctggaatcgatttttatgttatgttataatatatgttatttataacagcacttcattatagtatcttaaaaaatttagaacaaacgagattgttatagagaggtttgattgtatgtataataatcttcttgcagctgatcaaaagtgtgtttttgaaatgcagacatattgggcacaagtctttctgactccaaagaaagttcatgaaatggttactgctatatgtaggaattttctatgaaaagaaagcattgaaggaagaaggcaccaatagcttggaaaactgtttgtagacccaaagcaacaggaggtttgaatgttataaacttctcagtgtggaacaatgcggcaataggtaaactactatgggtaatagcacaaaagaaggacaagttgtgggttatatggattcataatcactatatgaagaagaaggagttataaagtatagaaactcttaaacaagctagctgggtgataaggaaaatatttgaagcaagaagatggctaactaatggagtgaaggagtttgagctatatgcagtaaaggagaagtatatcatcagtaaagctatatttcatttatgccacaatgtccaaaggtcaaccgaaaatctctatttttgacacaaggattgcttcctagacatcactttgtgttatggatagcattgcatcagagattagcaacggtagataggctagaaaatgggggataacagtgggctaaggaatgttctatgtatgactaatacagaggaaattcatgaacatttgttctttgaatgttcatactcaagatttatctgggagcagctgttgaaactctttgaaatcaatcgactagtaggaagctggcatgaggaaactgcatggatgtcaactaaaacaaagagcagaaaagcaatttggaagatctcgggaagtgcatttgcaacagtagtataccaaacatagatggaaagaaactttcgaagatttcaacagacaagtagagaaaataggtatatagttagagaaattgtattacatttacatattaaaggtgagagttattataaatggagaagagtcttaatttccatgttagtatagatacttaaggtccggttgtggaacttaagtgtcaaaaataggttatttttgtaagacccgactctagagtccaatgagcgggtgaatatacatatttcacctggttaaataaaaagttttgcagtttatcaaaaaaaaaaaatttcttcgctactacgtagaggacttcataaggaagttttggagcaacggtaaagttgtctccccgtgacctataaatcacgagttcgaatcctaaagacaacaattaatatattagactgtttacatttacaactctttttcgaatcttgtgtgaacacaaaatacgttatgtgaacacgaaataccttatatatcgaatttcaaagaggactctaattaattgttttccctcttccattgtcaagttttaaggactctcctttattgcacttacgtatagtccccatctttggttttgataattgatgtgagagaggtttggctagagatgcattaaattgcaatgtccaactcattatcaacttgtggccaatatctaaattctctcctttgtctgatataatttattactcacttcgtttatttttacttaaaatatatattaaaaataaatttttattttttatttatcattttacgtatattaagagaagataattttttttttcatgttatacccataatatttactagtcattacaaattattttttcaaatccaataaaataagcatcgattaatatgggtatcatgtaaattatgcacttcatttattatttattaaaggacgtaaaaagtcaaaacatgccaagtaaaagtgaacggagagaatataagttattattttgtacaaactcttaaaaaaggtttaacttgtatattttatttcatttctaaaaacatttgattaaatgatttttaaaaacaacaactaaagtaactcatagtaagatttataaactaacgatgcaaaaatacaactggttagatatatgatacaatacaacatgtcactcattttatttattaattcctcctaatcattttatgggaaggttaatagctcagacataaaatcttaaaaattaaagaatgattttcatctataagtcaaatacacataatatatgtattatctttttgttgaaaaagatatgtatgaaatttaagaaatactttgtcctattttatgcatacatatttgattaaatgcaaattaaaataaaatttaaaaagaaaggcaaaatacttttgataggtaatatatagtactccctttttatgtatcatactttttttagtccgtcacataaaaatattcatactttttatttaaaaaaatttaactttaaaatatttattttacctttagtgaatgaacataagatttttttggcttttcttttgaaaaattttcatttctttccgaaatcagtgtttggccataaaattttcaattttcacttgaagatgaattttggaatttttccaaaatgttaaaaactctaaagctgttttttcaaaattttcacttagatcactcaccaaacttcaaaaacaatcacaaaattatatttatattcaaatacaactctaactttcaaataccattttcactttaaaaaaaatattttttttttttggaaatttacaattcttatgtccaaacgcccactaataccataaatttctgaagtttttttttctaaattttaatgtagaatcaaatactatcacgtaaattaggacgaagggagtaatattactcccttcggtccataataagtgattcttttggttgttttcatatagattaagaaatacaccttttaagttaaatagcaatgaaattgatcataataacctttaatatctcttcacataaatacttctaatatatactccaacgacaatgtaggaaaaaataattaatttattattaaaatctaaaaagtttatttattttagaccataaaaaaagaccaaaaaatcacttattacgaacagtagtaaatacgttgacagcagcctaaaagaaacttttcggctacttatatagttgtatgtgcagaaaactatatattataaggattaaaaaataacggcagccagagatatatatgaggcggtcgcattaacaagtctctccagttttgaaaatacgcgggtacccgccaacgtggttcgtttacgccctcacaaaaacccaaccataaacacacacacacacacagtaatcatctctctctcactcactcactcgccgatttcttcattcgtaagcatatatgcattcagatttttaacaaaattgattcgaaccttagcttcaatagtagtgatgggagggggaggaggagagcgttcaatcggagctttagtcccgacggtgaaatcggagccggagaatgccggtgaaacttcagtaccggcggcagtgacgacggacgttcaggagcaaattccaatgccggagaaggaagaggaagtggataaggacatgttatgtccgatatgtatgcaaattataaaggatgcttttctcacggcgtgtggacatagcttttgttacatgtgcattgttactcatcttcacaacaaaagtgattgtccttgttgctctcattacttgactactaatcgcctttaccctaatttcctactcaataaggtaaaattttcaagccttttccataaatttgtatgtttcttgtgaatttcggttatacatgatgtaacgtataccggatttgaattttatgggttcagattctagggcaatgacctcaaatgctaataattggggataaaaacttacccgcacctggcagcatatcttcaccttcactcttattactaaactatagaaattagtatacaatttcaccttaatttataatttaaccatgataaatggtttggtgtaaatatcggtgcaggtctaggctgaaattgggttttgttgaacccatagcttacaccgtggatcggcacctggtaattatcacatttatttgaaatgtatatgaacgaagacaaaattaaaaaaaaattaacaaagacagaaaatgtgtttgcgacttctgttaagatcagcatgttgtgtagctttttaggcattactgggtaatagtaccttttaaattgagagcagaattttaagcagatgagatgaattggacttcaggcgcttttttttaaaggtgagatttttgatgtacttaggagaattatcatgttctgataatacaactataatgttttgaaggaatctagtttcatcctgcttacctgctgttttggtataacttggaaaagccgaacaaagattggtctttgtgagcaagtccaataggaataaaaaaataaaggttcataaggaattatcacgctggcctttgaatgtcatggtttttagacattgatgtttaattttgctcaaaattttcaagtcagctaatgattacgggtattaatgatttaccaaagctattttatatgcttcctcaatgacaaatatttgttggaatacactgcagttctgtggctgggagaaagttcccttcactaggatgaacaactctctatatggactttttgaatgtattttatggtattttagaaatatgtttattatatcaagctgctcaagttatcctcaagagagctagttttaagtatctcgagtctattatctaagataacggggagattgacgaagatgtcgcacatcgtgtcggagcgggtggataaaatagaggctcgcttccggtgttttatgttaagaatatgccgcaaagacttaaaggtaagttttatagagtggtggttcgaccggctatgctgtatgaggctgaggttggccagtcaaaaactttcacgtgcagaagatgatagtagctaagatgaggatgttgagatggatgtttaggtgtactaggtgagataatattaagaatgaagctatcgaggacagagtgggaatagcctccgtggaggacaagatgcgggagtcgaggctgtgatggttcagacatgttaaagggagattaggagatgtgagaggttgaccatggcgagtttgagaagaggttgaggtaggcctaagaagtactggggagagggaattagacaggacatggcactgcttcagctcattgaggacatgacccttgataggaggtgtggaggtcgaggattaggatagaaggttagtgggtagtttcttagttgctcatcgatagttttagtagcacgcatgttccttcatattcttagatttttattgcattatgtgattttgtttgtctcagatattgtattccctgttgctattatttggtactacttatcctttatctccctctttttcttctctcttccattcttgctttttctcttctttttctcctcacccttttcgagcctaaggtctattggaaacaacctctctacctgcactaggtaggggtaaggtctgcgcacaatctaccctccccagacccaacctgttgggaacatactgggtttgttgttgttgtttattatatcaagctttactttggttaattcgtagatataaatgtaccggacgttactctggtttgatctgtatctccccttcgagtttttgttgtacgtttttacaaattctatcagactatcacaactctataatgggctaaactttggagtgaaaacttgatagacaaacatcttattctagtttttattccgtttgtttgcatttttcttctctttgcttctttgcttttgttttatggtcattacttcacccttttttaagtctatggaatgttgttaacatattgcgaaggttatttgccagtcaaaccaagttgtgttaaagttttttccattatgtagttattgatgaagagatctgctcgccaaatggccaaaagtgcaacacctgtggaacaacttcgccaagcaattcagcaggtcagatatgcatggaaagttaaacaagctttgtccattaaacttagttttggtggagagtgttcctgactttgtatttcagttgctctttagtcaggttctttgtttatcttcttgcaactgccatcttaggctcagatgaatttgccgtttaactctctctgccagtgtttcgggattatttccatatatctgttcaggattctcatctgattcttaggcagggatgcgatgtgtccatcaaagagctggagagtctattatcactacttatggaaaagaaaagaaaaatggaacaagaagaagctgaaacaaatcttcagattctgcttgagtttctccagtgtttaaggaagcaaaaagttgaagagcttaatgaggttttgtattgaacttcttctgacttgcacatttcacttttagtttgagcttatctgttgtcaacttgaaaacttaatgtactttattctattaattctcatccctccagcaggtagggatttgcttttcttgtacagtatctttgcattctaactgaagaaagaatatttaattgaatattatagggggaaaagcaacatatcgagttggtagatacctggagcatgccttttctgtcagacttaacgtgacatatttttgcaatataagtcgtaaatttcaggaaagctctaaccgtcttctgtctccggtaacttgctaagaaaggaggggtgcatattttgttattatttgaaaagattaaacccatgtgaccatgtctaagagttccccttttgtacatattgtttgcatttctttcattctacccatttaaggggattatatttggagtgctcttacaaatcgtcttgtttgttaaatttcttctctaaaaactgtagggtccttacaaactggcagttccatatattatatagaatagacaaccttaatctcatctttctctgctgattaattaagactcaagcagattattgattgtatcctgccgcatttcgtagatccaaaatgatctcaagtacattaaagaagacataaatgctgtgcagaagcatagaatggagttatatagggcaaggagtagatattcagcgaaaatgagaatgctagtagatgattcttcggcaatggcagtcaggccttcattgggagataaggaaggtggtgaaattgtttctagttctgtcggttcacaagaacaagttcgtgtgggtactacacagaccaggaacactgatgcaggtgctcctgggatttctcaacttgttcaatggaaggatgaccgcggtggatcagattcacaggatcctaatcaacctgtacgggcaatagcaaggaaaaaacgtgttcacgcacaggtcaattctgtaatttatcattgtgcttgttgatgttgttcattgttcatatgttctcttcttacatgttcatttgtcagcagttcaatgagcttcaaacctgttacctgcaaaagaggcgctattgggcaagacactcagagaaacaggaggaaagggtagcaaatgtcatgaatagagaaggttattctgcgggacttgaagattttcaatctgttctgtctacctttacgcgatacaggttcatcagtttttatctaatgatttttgtattgacttgaaattatcctatgtatttgggcttatggcttttttctactgtgcttattgatgtagtcatttgagggttgttgctgaacttagacattctgaccttttccactcggccaatataatttcaaggtacgaagttcgttgcatttagaataattcaattatataacttactttttgaaattagaactagggatattcggttattagaaaatatggtaatctgatatgcttttttctggatacattatagcaatccccttctttaagtataaaccattgatagccaagaggttttatttgctcttctaagcccagtacaactcttttttgcaagaactcttgcctcacaaaatttcctctttttggcagtattgaatttgaccgagatgatgaattgtttgctactgctggggtgtcacgaagaattaaggtctttgagtttgcatcggtaagttcatgcttcgtgagagctttctgaaaattctgcaaatcttcctaccagaaaaccttttgctactagtttaatgatatgtctattaattagacttgacttttagccccctttttcttctccagataggcttttgaggttttcacgtgcttttgatgtaatgaaatgttttgggagaaatcagtgttcagtttagttgaactgagattatcactgttcctagttaaataatttcaataatatggctagatttgagtttttcataaaatctgctatcttgaaaagatagaaggtaattcttgtatgttctctttatcaggtggtaaacgaaccagcagatgcgcaatgtcctgttgttgaaatgtctacacgatccaaattaagttgtttgagctggaacaagtgcactaaaaccagttagcaagcagtgactatgagggcatagtgacggtttgggatgttacaactcgtcaggtagtatcttcttccagatgtttattttgttcttatatctaggacatgaaaagcacctttatgtggatatccacttatatctgatgagataatattacactttctattacagagtgtgatggagtatgaggagcatgaaaaacgagcatggagtgttgacttttgctatactgaaccttctctgcttgtgtctggtagtgatgattgcaaggtaacatagaacttcaagctatgtgctttcctctaattgagatgtttctattctggtgtttggagtgacaatcatattgtatctgtaagttgacaattttgaccaagtgaggcagatgaaattgggatttatatatattggatttcttttcgctcagagatcttaagtctgtgtgtccatttatgttaggagtgactatcatggtttagtttattcaatttctcttgtaaagtatagggataagatacagatgattcatcatattttcagtttgacatattctgattaaggtctggttcagaagctggacattaagttgagagcttaagatcctcagagtggtggacgatagttacttccaatatggcttattttccttgtctatgttgtcctgtattatagaatatatattaggttttgtactgaagtagagcacaatcctcgaatgtgagcaatgtcgggtgctgtggtttgcgccttgtgtcgtccaacaatggagttaaagtgtgctaaaccaaaagaacaaaagttgttttggcgagttatatacttgtaaagatttggaataagcttaaattaatttctcaacaggtcaaagtttggtgcacgaagcaggaagcaagcgttcttacgattgacatgaaagctaacatttgctcagtgaagtataatcctggatccagtgttcatgtagctgtaagttctcatttcctctttacttgtcccccaaaagcggttttgggttccccttgcatcaatgcattcaattatagtatctcatgttaaagggttaaattctatgctaaatcatgatccgatatcttgcaggtaggttctgccgatcatcacattcactattatgacttgagaaatgttagccagccactgcatattttcagtgggcaccgtaaagctgtttcttacgtaaagtttttatccaacaatgagctagcttctgcatcaacagatagtacattgcgtttgtgggatgtcagagagaatgttccagtaagtaatcatgctctgagaaaaccattgcaatatggaccataggcatgaactaaaaggaattagaaaaatgaaaaagtgaaggacggataggagaggtagattatagttttgcttaattcctgttctcactcatataatgtaatgaagttgaattgatattctcttcgacagacttgtcaaacttctgaccagcattatccttgttctatttttaatttcagctgcgtacttttaaaggacatgcaaatgagaagaactttgtgggcttacagtaaacagagaataccttgcatgtggcagcgagacaaatgaagtgtttgtttatcacaaggtatatttctgaaagtatttgacaacgagtctcattatccagatacatgagcgatggaacatcattttccagtgcttaatatagtttgtaatacatgtacaggcaatttctaagccagcagcttggcacaaatttggttctgatgatcagaatgatccagatggggacatgggatcatatttcatcagtgctgtttgttggaaacgtgacagcccaacaattctaacggcaaatagtcaagggacaataaaagtgcttgtccttgctgcttgatataacatttgaatgatcgattaacatttgactgatgaagaggcttgcaaaagaaagaaaggaggtacgagttctctacagcaattctccggtgtacatggataaccagagtattaggctaactttggtttttgattttggtggttcctaatagccaagtctgttagcttttgacccttgtggtccggcccttcccggaagcttagtgcaccgggctgtccttatagtcaagtctgttagcttttgacgggtgattatacagtagtcgcataattcttatagatactagtatgtatctcttctctggggttctgagtttaaaagaatgtcctagaagataggagagtgaaaattgtagtgaaaacatgtcaatggtagatttgctaaattcgaattgcttcttgtttgtgcaaaaacttctttgcgccatctaatttagtgatttagatcatcattttgcagctttactccgtaaacatcattttacacttgccactcatgtcaatgaccaggagtctttattagtctccatttctaatcctccactcacatggtactaactactaagtaggcatttggacatgaatttcaattttatttttcaaatttggaatttcactaaaatttgaatcggctatgaagttgtgtttggttataatttttggaacatatttggaagtctttttttaccccacaatttgtaaaaatatcaaaatcatcccaatttgattaaccttcttgaaacaaacaatcatataatcaactaggactagtgggaaaggcagctgcacactttggtgagaaaaagacctgctgcttgagttttgtgtttctgactttatggaagggaaagtgagtagtttatggttacctagcttaataaatgatggggtctttttataaattttaaaaataaagggtaaatttgtaaatattgaaaagaccaaccttccaattttcaattgaaaaatcggttctcactggttttttcaatttgaaaatgcattttaaaatgagattgaaaaaattgtaagattttaataactaaacactgttttgaaaaaatggaaatttttcttatgtccagacgggttctaaattgatacagagaaatcaagaaaagtttttgtttgtatgatacttttttctctacaagatatcttaccactctatgacattgaacctaattcaacgtctagaaatgaatcttgaacctaactcttatatggaaaagctcaaaaatgtactcaacgtcaagtaaatcaagaagtgagatgggtttggcttaaatttcatggcgaaatataaattttgagtttaactctcaaacctagtagttactgcaggatcaaatatcatagttgtaccgactacggtagaatttctcggtacaggaagtccctccgaggtttcatgaggtgagaattattctggactatataaggagatattccatgtctcacaatctatgttacatcataacaactgttacgcggcgccttcctgagatttttttttggaagggcgacgtaaggctaagcaatcaatgccagggcgattgctgtctgccaaatggggtcccctccgtacgctagactagattgtcattgccgtacgggaaaaccaatgtcaacaattgagataacagtaatgagaattgaatgaaagcttgattgcattaatgaaagttaatacaaaagtaggcaacgcggtgtcgagggggagagacaccaatacagagaattgtttgctagaaagttttcgaatgcttgatccccctaataatgcttaaaaaaaataaaccaaagttaaaggaatagacctaactaagctagaggatcataatgaaattacaaggaataaaactactctatatttacaaggaaaaggacttagttttctacaaggtagaaacaggtccgttgtcagcaactttgtctcaggcatcacgatctgcgcgcgcggcattgtctgcgcgcgcggcgttgttggcagctgcttgtggctgagcgctagcgagggacatcggtggggcgacagaggcacatgcgcgcttgtcacttggcgcggcccagaccacggagtcgtccgtggcgctaggcgttggaaggcttgctaggacgccacggggcgcgtccaaggggtcatggggcatggctgaaaagccgcgcatgacacaactattgctggtctttttcaacttgttctcttatatctttcttcttcgtcttccatttgaaattctttctcagtgttctgaccatgatgaacattatttctacaaaaagtttaggcagtaatgtcaaatctgcccgagtaactttgccttctgttagacgtttggccttatattatgttggctttatagaataaatctcgttttccgttgattacggttggaacttcaatataaagtttaattttgaactatagtcaaaagttgaaaggtaaatataactattttttctcaagaatttagacatgtacggcgtgttcggtataacggaaaatgttttctaaggaaaatatttttcaagaaaatgttttcttggaaaacaagtagtaattttattcattttccggtgtttggtatgcaaattaatgaaaataacttctcaagagtattcataaataatttagatacaataaacatgaaggcataaactttcgaaccaacaacctttggaacccacaaatttcataaacttccgaaccgctaaactttcgaaactgcgaaattttgaacccataaaatttataatttctaaacccgtaaactttcaaacacataaatctccgaactcataactttgaaacttgtaaaatttcgaacttgtaaatcgaaagatgaaaaacctaaaagtgaaaatatattaaaaaaaaatatttttttggggggggggggggggattgggtggtgcaaaaaaactaaaaaacagaaaattaaaaattacaaaaaattttattttaaaaaaaaaccttttcgtgcggggtaagggtgccggggggagggggtagtagggtggatggtgacggaaaaaactaagggaaagacccgggatgtaggagattataacatgagtgattcagcaaatttagattcatatatatatccacccatatggtacttcattctatgatatatatatatatatatatatatatatatatatatatatatatatatatatatatatatatatatatatatatatatataagatccatctgtatagatatcatcatctacatccagaaagtcgtatgctttggaagaagcttgtacaatttgggaaggggttttgattgatcaaaagaagaatctgaaagaaaaaataaacctttttggagagagcgggtggggtgggtgtggggtgaattagtgaaggtgaggaaggttgaaaaggagttttggaaaatgtttactcattctcttgacaaggaaaacattttcctccaattggagaaaaatgagttcacaaagaaaatgttttccaaaacatttaagccaactaaacatgaaaaaattaaaaaagttgtctctgtgtgatttatgagtcaagagttcgaattatgaaagccagttactaatgcttacattaaataggctgtctacatcatacccttaaaatacgactctttctgcattttacttaaacatgaaatactttgtgcaccgaactgctcgccctgtcctatatttgaaggccaatggttccaagttgttctcattacgtaataaaattggttgagtgcattatttttagaaagtccctttcgaagcttttgtttccttgcccatcttaaccacaaaaatacagtaactttaaccgtccaaaaaggacttttacaaatatggacaacttatctcaaaccaaattcccacttgacttctcttactcatcaccttccaacttagatttaatattacacaattttcccgaaccccgttcatatcgggagcttaatatattaacagtaatagactcagaattttatgtaaacgggttcaattttaaaagtacattattttagttgtaaaataatagttgttaagtaggttcaaataaaatatttatacaaattttatgcagctttaatcgtaatttatacatatacacaatattgtttttatgatgtaagttcagttgaacccgtttaccaccacgtgcgtccgacacggtgtaccgagctgcttttttttcatccataaacagttaaacaactaatttaatcagattagtcagttcaagatgtgttaggtaggagttaccttatatatcaaactactaaattgcaattatgtttatttgaatttgaagccataaatcataagttaatgaggatgccttatttcatgatatattatggtcatagaccaaatcaaattattttcataatcatctacttatattataaatttgcttcaaacaaaacatgagaaggccttatattttcataatggaaatgcttagaaatgtggttcggcataatcggtaaagttacggacatgtgattagtaggtcacgagttcgagtcgaaatacatgataagacgatatatattagacccttataatccagtccttcttcgaaccccgcgcataacaagagcttagtgcatcgggctatttaatgagaaggaagacaacaacagacaccaaattggctgatatactttttcattgttacacatcaattcttttgataatatgatataataaaataaagtaataattaaaataaatattatattaaaagtaataatataatgagtgcaaacaattaatatatggtgacacttgagatgaagtgaatcagggacggtagaatattagcttacagattcggccgaatccaatagttttgattcaaacttatttgtctaacgaaattcattgaataatgtataaattattaatttaaaaattcagtaaattaaaaaggactaaaattctgaaatcataaactttaaatcttggctccgttgaagtaattaatgaactaaataaaataaaatgtaaggaatctaaaatattcctcaagattcaaggaatcaatccaaatccaataacactactgaaattcacttaccttataaatacaaaaataaaattcacagtcaaactctctttatacttttttcaatttcctaatcaaatacgtaatctgtctttaacttggcgccaccacaaagcaatgcgattggaaaacggcgacgatcgatccacgtgtcaccgtattgaaaactccggcggtagcgccgacggtttgacggagaatttttctccggtaattgacgccggtgaaggactattcgttccgcctctcaatttctctatggttgattatggtgtttttcggtctggtttccctgatactgctaacttctcctttttgcaaaccctaggccttcgctctatcatgttcgttcgttcgttcgttcattcattcatgtgtttgttacttaaagtttccttttaaaaaaaaaaaaatattttaacgatgttattgttattgatttttctttgtttaaatatgtagctatttgtgtccggagccatatcctgaagcgaatgtagagtttttaaatgcgaatggaattcggctttttcaatttgccattgaaggatccaaggtatgatatagaatgttgcgatcatgctatctcgatttgaccaaaaaaagagaggaaagaactgaaagtttactaaaagaagaccttttgaactatttgtaatgtggaaatcgtgagagttgtggttgatgttagaagctatatgatcattatctgatatatcagtgcatgaagctgttataattcattgttttttgcatagactaaataaattttggaatataaccccaagttgtcgtttcagaaatacatacataactctccggtacctatgttgatcagagtagggttgtgcataatttggtaaataccgaattgctgtaccgaaaccggaaattttggtattctgtattcgattttttggtattcggtatggtatttcgtttaagttttaaaaaaaattggtattaggtatggtatatgatattttaaaatgaaatatcgaaataccgataccatactgaaatatatattatattacacaatacatattttattaattataacttaaatataagaaatctaaaattttagtttcctttattctctaagttcgtcaattaactctaagcaagcaacaatatatttctctaagttttctctctctaggttggtatttgctgattttggacaaaacttttgtcaatagacatttttagttttgtacttttgagtactttaattaagaatattaccgtctatggctctatgcactagttagtattcaaaccgaataagcttaagtcaccaaaccgaataaaccgaaaccgaaaggagaaaaaccgaaccatactgaattttattagttacggtattggtataacaatttacaaaaccgaatatcgaaaataccgaagcgaaatgtctaaatattgtaccgtaccaaccgacgaacacccctaggtcggaggtattaggtacccggtggaatagttgattaattaggttaaggaaaatgtgaggcgaccctattaaagagagcattaaggatacattgactctcttggatttcatgtaagttcaagccggcctgaacaccacggtcattaaaaaaaagtacagacataatgtatagttaagcttttcctcagtcctctgccaaactatcccaataatctatacaagttgtaagcattagcagaaggacttgtttgaagattataataaaaataattgattcactctttatctttatgtgatatcggctgttggtggaaacacattgtttttgctctctaattaggtaagtgacttgttttggagctataacagaatgtaaaagtgggggttagttgactggttatcgagaagaagcctatttattgacatggatacttaatcaatctgtttgttctcatccttaattgttccttgtttgaagttattctgatttgtatagcatgacagggattcatcaatattttctgactaaaatggcattaggttgcttttttcttcaatgaccaaagtcaaaaggttttgtggtattagtttgtaggagatggggttataaactttgtggtctcggatattagtcagttagcagtccgttggagtagtcaccggagtgacccttggtttttcttttagttgtgcaaatgaactagatatttggcctttgtggctcagactctaaagaactagtttaactgtttaagtcatgctaaagtctttaacttgtacttgaggttttcttgttttaaactgcaggtttttcacgttttatattcatcaaataggagttgaggttgttctgtatgtgataggagtaaagaacacaaaagtatgtgatgtgtctgtttacagattgctcaaggcctataatatgtttaaagtttttcaccacagaatcttgtcacttgcagcttcatgttgtattttttattctatgtttctctcaaggatctagttacttaaaattcctctctctcctctaaattgcactctgcttttacaacaaatgcgagtatagctacagcttcttatactgattccttctcaaccaccactcaacattacttgtcgcagttcatacttcataaggtcctgctgcatctagtgctacttgatcattcttagcccttaatttgttttccttctatttgtttttactatattttagctttccccggttcttgatgcatgaaccaagccatgatgcataattgtatctagggaattagaaaggtcaattgaattatactatcattgggtttagatcttcagtttgtgaaatatttccctggtttcagtagtgttacagtacaggtaatgctgcaaccaaaaaattcataattcaagagaggaggtagggagtttcttatggattcccaatgtctcaagaaaaattgtccaatttgcgcattctaagtgaggttaggtgtttattgtagtagttgatcctgttggagctttgcacttccttggagaaaatcttcaactgttgcgtaggagataaagaaattcatccactagcaaaagccaatatgtaattgcgttctttttaattcaccagtagcaggtcatattagctgtagggctctccaaaatttgcttatcccaactaattggattgctaaacaggaagataactagatgattgactgaggagaaaaaaaggacgattctgtaggtttctcaagtttattgctgttagtttgtcatatctataatgttatttgatatatatatcaagtcttatgtgttatgactgttttcttttattaccttcttatcttgagtagccttagaggaagtagaatcgttgcctatcaaacttgaaatctttcgtatttgtcataccctcttctatgcttttggtttttaattatcataagctagcttgagttctctctgctgtctgaatgctggaccaagctactctaccatttttcgtctatctttgtctcctcaactgaggctttgagtagttaaacgtccttgtctattcttgtcctgtaacaactttacgcaccacaacgtatgtggatatttgaagcttttggttaagtgaagagatatattaccattatggagatggtttgcaattttgaccaagtattgctatggttgcagtctataccggaagtacacgtactagaaaaattagtagtagcatatatgaacattgtgctatgtcttgtttgcagacattttgaatttgcatatgattatgcaagccgtgtatgtgaatgttcttaagctatttcattctaggtgttgatacgaaacaaaaattttcatgtggataagtaattgactatttctcatgcaggagccaccattggtcaacatcccagaggaaacaataagagaagctttgagggttgtccttggtaagtttgaaagtttggatcttattttctctcttactgtaggtttctgtccagtagttttgctaaatgatttctctattacaatttcactcggttcttttgtagatgaaaagaatcgacctctgttaattcactgcaaaagaggaaaggtattccttcatttctcttttttctaaaatttctagcttccttatatatataatccacacaacattcctctggccttcatttctgtcatcggtgtatattatgcagcaccgaactggctgtcttgtggggtgcctcagaaaattacagaactggtgccttacttcaatttttgatgaataccaaaggtatgctgctgaaaaagctagagtatcagatctgaggttcatggagttgtttgacatttctggcttcaagcagccgccaacattctgttcgcatacaaagaattaattcgataagatgtacagtacgggaggcaattttggcgttgcatttttaattgaatcatttgagtccagtcccatgagcactggattcctcatatgaactttgttttatggttttcgctagtatccaattcttatcttttggatgtaatctgtctttttagaaagtagatggcatctattagatgttgctatgataaaggggctcctcctctgttatttttttgtgttcactagataggggattgagagttataaagttgcattattttgcttattagagggaagaggggaaggttgttttcttcagtttgaactgtaagaacttggaaccctgccaaaaggcgaaagctgttataaatttggatttcttcagtagatggtcatgtgaaactatgttgctcggatcctccaaaaatattgtccgaactcgtgttggatcctccaagagtgatgtgaaccttctctcaaaaccaactcacctggaatcaatcaattgtagtagtataccttttgtgtgcttgttgtgttactaataagcccacaagaaatttggttttaacttgattccggcccaacactctttggtctttgcccgtttgagttgaaatacattttcgatcatgatactacaagctatagcccaatcatgtttagatgcacaataccagccaattcaaaagagataatggtttttgattggattcgaagccacattaaagtgatataatttttctttttaaaaaaaaaatatttggtctgcaacaacaacagcctaataattttcatttttggggtggtttgcacaaatagggcactttgggtgccgtttttgattttttgatcttgcttaccccatgggtaaaacatcaagtttcacaagtattttccttttgccccttgcttgcctatggacaaccttttgacttttgatcttaaaggtttgtccgtagggcaagcgggagtcaaaaaattaaatcattcattttaaggtcattgagtgtaactttttgaatctttagttcgaggtttggattttgaaatgaatgatagtaaaatattttatacatatataaattaaatacaaaaacaatactttagttacactttttagaaaagattgaaccaaaagtctcaacttgattggccaacctcaaaatctaagtaacttaaattcattagagaatctagcagcagctagtggcaacgttgttgtcaagttcaaagggtttgttaaaaacagacaaatcactttgacatcagctaagatagatttgtctttttcacttttatttacttgttagctatgaaatttttcccgaccacatgaaacgtatgttatcctagtgtttttagaattatcaactcttatcttgggcttcccaatatataaataattcaggattttgctattatattctatttcttcttctttttgcatatgttctcttttaaaattcacatatctttcctttcttttcccaagctttctcttaatttttgagttaactttctgatttagagtgaattttggcatgaacactttccaaaatattataatatcaaaatgttaaatacataaaggaggagataaacattaccttttcaaaaataatactactccatatacaaaagaccaggctatatattaagggcggagctcgagagcgagttacgggtttggtcgaacctagtagctttggttcaaactatgtatttgtttgatgaaattcattaaatatgtacaaattattaatttagaacccagtaacttaaaaataattagaattcagaatatataagcttcagatcctgaatccgcctctggctatatgagtacctttatcaaaggttacttgactagagaaattgtagggataaattgcccttttacattatcatgcaccttaaaaaaaaatgcaaaaataacaaaaattcaacaacaataacaataataaaatccagtgtattctcataaatggggtctggggaggatagtgtgtacgcagaccttaacttaccttatagagatagagaggtttttttgatagattcttggctcaaaaaaccgtgagaataaaacaacaagtagcaagcaaaaataataaatatattttattaaatttaacaaatgtctcaacaaagtaatcatttcaaagcgtgttgctgttcatagccagctaatgcttttactctaaatctaaaagtttgcttttgttccttatccaagaaggtggatgtcacttttctaaactgcaaattaacaacccaaagagcaaggtgcgattacatgtaacaaattatgcttaacctacaattcagttactataattataatttaatgggtcatttgggtcaaaatcaggttatttcttggattataattctggaattaagattatgatagataatctcacattctatatgggacatataatttcatgattttgatatataattttatccttactttttctaatatctatataatcaaatatcggataaatttagtttcaaattttatataggaataatttccctaatctctgtaaccaaatgggcactaaaacttttaccaagcgtgttaaatcaacaacaacaacaataaacctagtggaatcttataagtgggatttaggtagggtaatgtgtacccagaccttacttctaccttatgaagatggagaggttgttccgatataccctcggctcaagaacactaaagcaaacaataaccaattaatagcaacaacaaggtaaaagacagtggaaacaaatggcacaaaatgtgtaatgtactagaattattaagaaagaaattgaagaagaactagtaaaaacatgattttgttattcaattgttcaattgattgaattacaacaataatgaatatgaaagagctcctgtatccacctgaaaaatagaagagaggaagaagttagagatatgaacaaagagagagagaagagaggtgagagtgtaacagatttaccagaatccaaaattgataactgctccacccaattctgttatttatttgctggtattgactagtaattgggctgctaactatggactgctaacttctcataattgggcttgttatttgtgacttaggtccaatacacagaataagcccactacaccagttcagactcaatcttacttatccacttctcatatccccttccttaattcatttcttcactttcctaattcagccacctcagacataacaaaatgctataatcacgaacaaagagcacaaaaatacaagactagtgccaactacgtgtgtgtaaaccaagccctacataacttgattcaccaatcgaagccaaatccaatatgaagatactactagcgtgactaggggtgacaaaatagtaaaaaaaaacagttaaccacccatattatcactaaaaaatgggttggatattgaacttttttaaaaacaggtcaaatatggataagaactatattatccatttagaaaatggataaccaataggtaaccaatggataacctgagtctgacttttacatttgtaaagcctcaaattgagggttcctcaagttaggaagactaaaaattctcccaaaaatgatcatatgcaagaagagcatggtcatattatccgccggttaatccctttttttatccatattaaatattgatcgggttggataatttatccgttttttcattactcattttcgacccgaactatatccgatccggcccgcccgtttgccacttctaagcgtgactaaggcctcagttatttttttttaagattaagacgtctgaatctgaatacacatatgaataacaagatgatattaagtctgaatctgaatacacatctgaatatattaagatgggtattaagatctgaatagaaataattaagactgtgatttttaacatctgaatgtataaaatttatctttatttgaaaattaataaacataaaattccaatgaaataactaatctaatattctatcgataaaatatatagctttttagaattgatagttgttgatggctaatgggtgaatgccgactacaggtggtggttggtggtagttttggttgatgacggtggttcatactagagctattagtgattagtagtgatggcaatttatgattgatggtggtgtggtggttgatgatagttaataatggcgggtggttaatgtggactgaggaaggtggtgagtgggggtggtagattataatgataggcagtgccggctgtggttgttgatggtgctgggtggtcaattgtgatagttgagatgtatgagtgttattgtgggtgagaatgatggtggtaagagtggtggggataacgggtggtgatggtcgataatgatggcgtctataattgagtatgacggtggcgtagtggtagtgagggtagtggtggtggtcgggtatgatggtggcaggcggcatggtggtagttgataatgatacgcggtggggcaattaataatgaatatatgatagcatcttaatgaaattaagtctctgttatagatcttaatcatacagacctatccagacccattaaatgattgtgaagtaaaaaaacaaatacacttaatgattaatatctgaataattaaaatttagactttaaaaacaactgaatattaagattcagacttccattaagtgcaaacaaatgaggcctaataagagatatcatgagataactgaaactcttctatcgttaattagaggattctcgttcttaaaaaattataattaaatttttttttgaataaagaatctcaattagttagaatagtaaatttcagctatataaatattaattgaaaagaaagaagattctactcggggtgtatgtatcacataagtgacgggtaaaattgttctctataattttcgatatggaacataaatttatgtataaaaatctattaaaattataataaataataaatataaacccataattttaaaaatatacttaattcaatactaaaaatcttaaaattaaacccataaaatttaaatagtggatccgcctgccaatctcatcataaaatcacagatctcagttacaacttacaaacacgatcacatatcccacccagctaccctcgaaacccctgaccaaacgagtttattcctgcgcatattcttgccaccctccatctccggtcaccccccaaaagtactagtattaaaacaccaagtacttgccacgttcatctccattcgccccaaaaattaagacaaaatttatttatttatatatatatatatatatatatatatatattattgaaatattatttcgaaaaaccaaacatttttcgtgaccgtgaccacaagtttttcaccaaactctttcactacttcctaaaaaagaaaaagagccaaataattattttctctaatttcaatattatgtaattcttagatatatatttaaaaataattaaaaataaataactaattcacatcataaatgaattacacttacctttatgtccaaagataaataacatctctcccgttaatttaacgataatttattcgaatcgaatatttatatcaatttttatatattcacgttataggagtattatttaatcatagttaagcaattcactttcacattaaattattgattcttaaatttaattagatataagtacaaagcatttacgtaatttcctcatcctcttcttacaatcacgtaaagtcctttttgccctttgacgtttgctctcattacgtgccacctcaccaccgcacacagtcgctcactctttacgcattctcaccaccatataaatacactttctcttccctctcattcttcacacactttatctcgtatattttcttctaattcacactcttcgagaactttcactctctctctctctctgtagatcacataatcttagctatggctactgctactctctctcctgttgataccgataagctctctaacctcaaatctgctgtttccagccttaaccaaatcaggtacttaattctccatttttcttctcaaattttccatttccgcgctgttcttatattgttttttttttttatagttttgttgcttcattttgttctggatccagatgctgatgaatttttgatttttttttggcagtgaaaatgagaaatctggatttattaaccttgtcggtcgctatctaaggtacagttggagttattattactctgatttactaatttatgatagtgatgattcaaactgtaatttatcagattttttatttgattaaatactgaatatttacgtgatttgtgattgttgtgagtcagttgatgattgtagtatatttttttgtactcattggaaaatttgcataaatttacataaattgtttttatctaattaagtactaatttagaatagtgatgagaactgtaatttttcacattaatgttttacaatctgaatatttacgcgatttgtgattgttgtggatcagttgatgctttgaagtatatatattttcttctaaattttggaaaatttgcataatttctgagctttgcacagatcaaattagtttgcagcttgcaatgcgcggatcacttcacatttctgattttcttattagtttttctattttgcttattgattgtttctgttgtggcatttctaaatcgtgattagaattgtaagttatcagattttttatgtgctttaatgctgactatttacgtactttgtgattgttctggatcagttgatgctttgtagtatagcactattttcttttctactccttggaaaatttgcataaattttcaatctttcacagatcaagttagtttgtagcttaacgcgaatcactgtacatttatgatatttcttatgttctgtttttgcttattgactgttgatctgttgtggaatttcaaaatcgtagtggagaagcccagcacgttgaatggagtaagatccagacgccaactgatgagatagtggtgccttatgacaatttagcatctctttctgaaggtatttgtattttctaaaatttatctttttgtcatctatcatatcattatcaacaagtgtgagcttggtgtgcatggattgttttggattaggtccatttgaatgtttttggtgaggtgcttgactatcttaatcaacgcagatcctgtggagactaagaagcttttggacaaacttgttgtcctgaagctcaatggaggcttgggcacaacaatgggatgcactggtcctaagtatgtattttctgcttatttttccttgccaattttaggtctcaggttctaatcccagcggaggtcatttctttccctctacccaagccttggtgggcagattacctaccgatggaggtagcagttatccggttgaatagtcgagctgcgtgttagctggccctaacaccaccgtcataagatagtggaaaacaaatgtatattgcaaatgtgacttcatttagcttgctttattggtgttaacccacctttacagcaacaattttggaagtgaatactgttggtggatacaaagtgctgtactcaaccttctgtgtcttttttcatctgatgctgctttatagattcatctgtctggatcccggaaatttctgaatcgtgtgcactggttgatgttaccacatgatactctgctttagtgcattcatcaggggagactataaagcgatatactttaagtggctatctatttttaattttataccctgtttcttaatgcatgatgtcatcagatgagagagtaatttaagttgtgttttttggtcgatcgagggtatcttcaaccataaacttacatgatctaattaccactagaatttgggcggagttggaatgctataaaatagactcacctactatacaaatttgctgcttgtgacgccttttaagtgtttctttaactatatatatgggggaggggaaggggaaatcggggatgggattacaagatggggaatcgaaccctcaccaagaagtgaaaattctggtagccaaccaactgcactactaagattccctccttttaagtgttaagaactcaggtcgcagtaaaagtaagatggtttgtgactgcgtgtaattagatcttattcaatcattcagctcccctgttggaggctctgatctatcctcctttgtcatgctgtgaataatgtagtccacgcaaatgtgtttctccttttaccatgtatatcctttcaagtattttataccgctggaagctagagaaaaaaaataaaatttaggaagacctggctttcattccatttttagaaatattagctttcagaaacttgcaattgcatacagatttgatgttctccttgtaaaagaagcattgtggtttcaattttgtcgatcacatagatgcaggaaatctgaaggttgtgttttctttgatgcagatcagttattgaagttcgtaatggtttgacattcctcgacttgattgtcaagcaaattgaggtacctgtgtctcaatggatcattttatccgtcatatgttccacttttgcctgttcaccggttaactcttgctcttgctcttgctcttgctcttgctcttgctctgtaggcgctcaatgccaagtatggatgcactgttccccttcttttgatgaattcgttcaacacccatgatgatacactgaaggtgaaataatttaactttgatgtctactcttccacggttaacttttttcctgtttggctgagcgcaagtgatgacttcttgctgtttcattccctatgtagattgtagaaaaatatgcaaactcgaacattgagattcatacgttcaatcaggttagtgtcaattaccgttaagtatcaaccagcttgtatctgcattgaaaagttttggatttgaaaagataaattattgttttctgttaaatatgtacagagccagtaccctcgcttggttaccgaagatttctccccacttccatgcaaaggcaattctggaaaagatggatggtaattgacagtttaagatgtggtttccctgatgatagccttttaaaattgaatcttaatcacactctggaacatgtaaattttccctgttgagttataataataaagtttcatcctctctcttcctttaaatctgagataagttagatataaattcacttcatttaaaaatagttagatcaaaatcaaatcactgaaattatgattttcctctttctcttgctagcaattggggtttcattgttctgttgatctgaataacctgtaacttataatgaaaattatcttcatttagctctgtctgtaattttttgtttcattggttatatattctactattttttctgcttcaaaaatgataactgaatgcaagtaattatgttatgagacaaaattgtttgctaaagctggctgtttcattggtttagcttgctgaattgcttactccaaccaatgtttccagtcgagtagactttaagaattatgattcctcgtccatcttttctagtttttcttttgtagatatagctacattcacttcgttcaagtacattgttctcatatacaggtacctccaggtcatggtgatgttttccctgctttggtgaatagtggaaagcttgacgcactactagcaaaggttttggtgctcaattattgccttcgtctgattatggcaggcatctggcagcttttttacatttactgtttgcttgaaatgtttcctattaattattatatctttcaatcttccacagggcaaggaatatgtctttgttgcgaactcagataacttgggtgccattgttgatttgagtatccttgctacgattttcattgttaattacactacagttcttttgtatgcatttaatgacatctcaatcatgaaaaattttctcagtaaagctattctcaattgtcatgtaaagtgcattgtctctttattttgcattgcagaaatcctaaatcatttgatccaaaacaagaacgagtattgcatggaggtattgacttgatattgttcttttagaactgcatcttcctaggtgaaaatagtatatagtttctgcgatgttacagcttgatgagtattgcaggttacacccaaaactttagctgatgtcaaaggtggcaccctaatctcatatgaaggaaaagtacaggtagtgcaatttattttttgttttagattcttatctttgaagctcagaagcaattccggtccatgtatcatctggagcacatagatgtttcgataacaacctacaaacaagtataactaaactacctagatcttgtgtacttaacttcaacattaaagtatgtctataggaggttctgtggtcaccccttcatattgctacctccaagatggcacatgtgaccatgaaaaggcagtacctgtgaagttaaatatagtttgatgatgcttgtatgagatcttactcaagacaaagtgcacaccaactctgagattggatcttaggtgttaagcactaatcctatgcagaggtggctgtatcattgcggcattgggttcattcgagccctgtattgttgatgtggaacataaattttaggtaaaaatacacttaaagttgcaacaaataatagatctgaacccattttttttagaagtacaatggttcaatgttaagaatcaagattgaactttagaaggtgaatttggtctttggtcttggtgatttcaactgtacctatgagtacacatctaatcaaactaacttaaattggtgcctcctattataattaatcagttaattcaatcttctctgtagctattcccagctgagatactttaaaaacaaattagtttgaattgcgtataggaagtccttcaaatctgctggcactcattgtaattttctcgcttctctaagagactcaggatagttatggtgctctgtttgcatgcgttttacgtcatatctatcaatttgcttattaaacatctgttttgtgtggtgctgcagcttttggaaattgcacaagtgcctgatgaacatgtgagttgtgtcttctgtttacgctttgatgctttatatgtaaatgttattagaaggtggaaactggaaagttacttaggtttctaaatgtactgcttttagtccacagttctctaattggactgaaatttgttattgaaatgtatatatccatctacatgttatgtagctagtgtcaagttgcaaatgatcatttattctgctagatcaatatttggtggtattattcaacaagatgagtttgaggttgcattgctttttcttccccagtttgaattttatccttttaacatgaaggatgtacgtgattgttctttccatttcatccaagaggtagctagttttgatgttcagttttcactttcttgatgcaggttaacgaattcaagtcaattgaaaagttcaaaattttcaacaccaacaacttgtaagtcagaatagtcttatgacctactttaagctttatattggacacttccttgtcaatgaagcatgtggtgagtgaatccttgctgttgtgcaggtgggtgaatctgaatgctattaaagattgtagaagcagacgcactcaagatggagattattcccacccgaaggtatcagtttctgtttgtttagcatgtgtccaaagttgtaacgctttgtataagtgcctgaggtagccaatctttgttgtcaggaagtggacggggtcaaggttcttcaacttgaaactgctgcaggtgctgcaattaaggtatgcaaccttaactctgtacctttaaatacccaaattcatacctttaagtcctgatatttttcgtattcttggtttctctttcttggtgatattttccccatcaagattactcattaccattttattcaaccattctttgaccgggctattggtgttaatgttcctcgatctcgtttccttccggtgaaagcaacttcagatctgctgcttgtccaggttaattgcaacctgagattgtgttgatttctgataatatccatcccagttagcttaagtggtatttgtgtgctcattcacctttttatctttgcagtctgatctttacaccttgactgatgaaggctatgttatccggaacccagctaggtctaatccatcaaacccagctatcgagttgggacctgaattcaagaaggttaacatcaactcctcaagtagattagtgctgtaaaattatgtgacatttggctgaatgcagttactatcttgtcttcttaggtggccaacttcttaggtcgtttcaagtctatacccagcatcattgagctagatagcttaaaggtgacgggtgatgtatggtttggatctggagttactctgaaggtaattagcaaatctttgttctgtttaacgtatgctcccatgttgatgacatattgtgttatttcagaatctaatattgtctcgcatcttctgactttccaggggaaagtaactgttgctgccaaatccggagtgaagctagaaattccagatggtgctgtgattgcaagcaaggtaaatacagttgatctaaactactagtggagctgctagatttagatttaactcagttttttgacgctgttacatcaatttccaggatatcaatggacctgaggatatatagaggagctactggtgctaaatagatttagcgagtctgcagcaagtacattttgtttgtactgaatgtaattttgcctcaaaatttaaataaatgaacaattttgactgtttgcttcagaaatctttgttgtataccttatggaactcgatatagtttgtttcttcatatttctgtagcttgtctacttcgttattttcagggaatttgatatacgtcaatcagccaaatttcaactgtttgcttaagaaaatatatgcaaaatctcctatatgtttgaagtaacatcaacagatgatttttgttatacgattttgttggatctttttattctatttaaattgtaagtggccgcttttgttggatctttttattctattcaaattgcaagtagctcgggagttcattttcgtctcaaacctgtcgactgggtaaaatagttgggtttcattgcatgacatacatacaactcgagaccaattgaagtccaatatataaaattgaaatcaactatataaaatttccatatctacctaaccccattcgagcatatatgctaatactaatagattctacaaaaccatatttagccgcagttaacagatgaaactgaaagaggataactaaaggtattggcatactgaaaagtaattgtttgtccagatgttaaaggctttccgtcattgacaagacagtcattataagcaagtcttctgaaaattgtagggtttatgagtcttgctgaactgaaccagccacagctcaggtgaatgttggagatgctgctacagctttcaaagacgcacgcgttcgagacgatgactgtgtatttggaatgccatttggaagtgtccctgagggaccttggtttactgtaatgtagtcttttgaacatgatgttggccctattctgtactcaccaacatgtctttctcgagtagtaccactttcctcagctggttccaatgcatggttaacttgcatcactgcattcagtaccatcaaaagatattagtaagaaagattttgatcaacattgaacattcatgatatttaagagtgaatggagtcaaccccaaggaggaaaaattctcaaaaaattaaccgaaagaagggcaagggtagccccgtgtacaaaatatcacgtgttcatgcagagttggggaagggttcaggaagggccacattgaggggcgaagctactttttgctaagggtggtctttgtcgaaatattacattgtgtacagtggcggatatagtgttgtatcaccggcaactgaatccataaattttgacgtggagtaaaagtttatgtgtaaaatttcattaaaattagaaaaatattatatataaacccaaaacttttaaaatgtaatggattcaacactaaaaactttacaagttgaacccataaaatttaaatcctgaatccatctccgattgtgtatataagtaaaatattagattttagatgtataaaatatatatcgaacatcttttgtggggaaatttttttactttctttcaagtctaaacaccctgggaaaatttctggctttgccaccggccacattccaagggttggcgtaaacagcctactctaatgcaacctttagtggttacttccagactcgaaccgtaacctataatcacaccaagacaactttaccgttgctccaagatagaacatcctactagaattctccaactccttttttcttttctggtaaagactatcaaaagcattaaaaaaagaaagacaatgaaagggagaaggaaagaagagagccctatatatttaccagagaatgaaacaaccaagaaaaccagaacgagaaggctgcgttcaccattaatgctcctcattgtcattcaattatattcttcaaattgaaacttcaaacaagaaaagaaaaaccttaggttgagagtacgaaactctcagagggatgggatatttatagtgtctatgtagtcacttaaaaggaagtttgtatatacaaacattaattagtaaccatcgaaaaatggaaaacaaaatcgtatattagggcaaaatatattcatagtgtaaagaaattcttatttaaaaataaggcaaactgcacgtgatgctctctacaaacattaattggtaaccttaaaaaaggaaaataatatttcctataatagatcaaaatatatagtgtaagaaaatttgtacactttcaatgtaataatttaaatcttaaatatatttaagttgtttatttataacgaagaggtttaattattaaatactactagtagtagtagttcatgcacaggcgagttatattactgttatttaataatgtcatgatgaacacgattaattaatgaagaagttcaaataatcatcaagaaccagttcaactgctataaaattgcattgaattctttaaccttttgttcatttaaaatattaatggttttggctaattatttacagcttcaaaatttcactacattttaatttccattaattcatctacgatgcatgaatagctagagagtgaaatatagggcaaatagcagcacggtgcataaggcatcccgcgttaatacaaggtgcatagaaaatgactgcattttttccacttcctaccagattctttacaaatatcgctaaaatttttaatttagttgcatgatccttttcaagggatatcagtaaagaataacacaaacgatttagtaaatttgttatttctcagtatttgtacaaatattctgaataaaataaataacataaacagaaatgtaaatgaaataagaaaaactatatcgagcccactgaattcacagtgtttccttaaggaatttaatccctcctagtacccaaggttatgaattatttcctcccaggatagaacgaattatacactggtgtagtggtacttcaaaccccagtatttcagcgaacacaaagttcagtagcaaatcacacttactgttgctttctttgaagtaggggtggacattcggtattttggttcggtatttaataatttcggtacggtatttcggtattcggtttattaattgtgtataccaaattccgtaccaaaatatttcggtacggttcggtatttattattttggttcggtacggtttcggtacggtttcggtttaatattcggtgataaagaacagggaagtgacgaactgcactaaaaaagtaaaaatagagtgctgaaattgcactaaactttaacattgcactaactttaacactgcactaacaaggagaaacattgcacaaattgcaaatatataactttatatgcatccactatccactgcataaaacatagatgtttctcaagctccatactagtattgccattttcatatattcctctcctcaaaggctcaaacttctgttcactaaacggccaaacacaatatcaagcttaacaacaaaaataccaaacgcaaacaaattacaaacttaacattctacacttaacaattaacacttaatagtatgctctgttacgaaacaattacagaacaaaattacagtccaactgttctgttacaaataccagttatagaacaaattacagtctacttaacagtatgctaaattgctaattttgagcactaaaatggagtagaacagaacaaaaacactgctggggtaggctgaaatttttctctaaaaatggctgcaaatcttttccctgaaaatggccaaccgagcatggggcgtgattgcacttaaacctaaacaatatataaatcataagttaggatattatttttgatgataataaaacaaaactacaaaagtatatcaccaaacaaatagtgtattaaacatttaaacttaccactcaagttgcaagttgcaactatacatcaagcaatgctagtagtgtttccattattgtccatatctaaagataactcgacaaaatatgtcaatgacaatgacaaataaacaattatgatatattattttgaactaaaatacacacaaaatattaaagcttaccaagctcgagttcctcaagatacttcaagtcttcttcaacactaataagattcttctcttctctaagccaatcttgaacacaaataagagcttgcacacatttaggagtcaatgaactcctaaatgaatcaagaatacgaccaccggtgctaaacgcgcattccgacgccacactagaaattagaatggccaacacatcacgagccaactccgaaagaataggaaatctaggagcatgtgttttccaccaacttaagatatcaaattcttcactaaaaggctcttgttcttcacttatgtatttatccaactccgatttagcacccccacttccattgtcttccttttgtttcttcaagtgaagcttcgtccttattaatgatgcagttataacactcccactagatgtattagatgtgttattagatgaagcaaaactagatggagattgaggacaaaatccagttgaatacttttttagatactcttcaaacaaagaattcatataagcatacacctcggcatttattttcttcccctttcttccccaaaaagttcttcaagtgctccctctacatattcaaatttattacgtggatccaagacggaagcaataaaaatcattttattcatcttttcaggctcaccccaatacttcttgaacttttcttgcatccgctcagacatttttcccaaattttcatcctcactaactaaacacattttcaaatgacaataaagttcagatacatcctcaaaatgagcattacaagtgacataacgtgaacctgaaacttttctggtgagctcgtgaaattttgcaagaaactgtatcacattcctcacattcacccaatcatcagattcaagaggacctgcactactaccatcttcactagaacattgataagcagaaaatccatcatcaaaaagatgaagcttgtcaaaggccttttcaaagttttttgccgtatccaacatcaaataggtggaattccacctagtaggaacatccaaacataatgttttggtacattctacctttatatgttcacaacactgtttaaactttaaggtccttgcaggcgaagctctcacatacctcacaatatctctaacacgtgagacagaagcatcaatttctttcaaaccatcttgcacaattagatttaatatatgagccatgcatctcacatgaagatgtttaccacccatcatattagttatccacatatctaactttttagacaattctttggctgtgacatcatttgaagaagcattgtccacagtaatagtgaataccttgtctaattttcattcaagcaaaaaatttgaaatagatttagccatcttttcacccttatgactagtgattgggcaaaaatttattattcttttatgcaacttccaatccctatcaatgaagtgagttgtcaaacacatataatttattctttgtaatgaagtccatgtgtctgttgtgaggcaaatttttggttgtgcttctctaaaagactttcttagattttggttcaattcaccgtaaacttcataacaatcccttgttattgttctacgggaaggaagatgaaattgtggttgagtttttctcataaacttcataaagccttcattttctacaaagctaaatggtagttcatcaataactatcatctcaattaaggccctcctaaccacttcttgatcaaatttccaaagtgatccttcatcactttggcaaaattgaaaatttaactttgtttgacttttatctttatcaatgttaggtgggtattctttgcatctattcaaatgagatttcaaaccgcttgttccattcttagatgagtaaaaagcaaaagcttgcttacaatatctacaccttgctttaccaaccccatttacctcaactttatcaaaatgattccaaacctcggatctaggttgcatgacttttcttttcttagaatcttgagtatcaatggtgttggtgttactatcttgagtaatagggaagctttcacttgaaccggcaacactatttaaactttcatctgccatctatacaaatagagataatataagattgtatgatcctaaaatcttgagtaaaatcctaaatgtggtccataaaattgaatttatgctaaaatacaataattatccacaacactgtcaattaaacaatttaactttacttaaagttactaagttagtagctatagaagtgtttgaaatagaagtacttacacagttacactagttaaacaatttcaaactaaccaaatactaatcaattaaacaatttaactttccatttcacatttacacttgttcatttcaaacacttctatataagtacttacacagttactgcatttcaaactactgcatttcaaactaaacctatagaagctactgcaattcaaaattcaaactaaaccttactgcatttcaaactaaccaaataggtcagatataatagaaacatcaaacatagacaataagaagagtgcaaactgcaaagacaagaataaacccatttatcagaataattaagaaagatgagtgagaaagatgaagaatgtttacttgcaaaaagaggaagattttccttttgttgataaatgcagattacagaaagcttccttgagttccttcaaccaacgccccctttattgtagtaggaagctatcggaatcaccaacgcggcaagccggcaacgtcagacggaaatggtgactaagactctgagaaagtgaattgtgagtctgtgaaagtcacaaagcgcgggtgaagccgtgaagaagactgaagagaactagagaagacggaattggaatttggaaatgtcgaaaattaaaatggtgacctaattggagaactagagaagaagactgaagagtgaagaggatcagagaggaagagacgacagagaagagtgaagacggaggaatttggacatgtggaattaggttaaagtaatttagattttagaaattacagtctttagactttaggagtggcagttgggcttgggggtcacttgggcttgggcgtcggcgattgggctgggctgggtgagatataggtacttaggtagggtagggtccaaaaacaaatgtctctaaaatcgttcggtataccgaaatattaaaaatccaataccgtataccgaaccgaaataccgaaataccggaattaatgtaccgaaataaatcgaaataccgaaaaaaaccgaaaccgaaataccgaattaattcggttcggttcggaattcggtttttcggattttatgcccacccctactttgaagtaaaactatgcagaaggaaggagaagaagtcataaattagtatgtaaaatctgagagaataggcttgtatttatagccaaagttgggctgaaatctgaagaggctgtttttgcaaaacgcccatagaataaatgccatgacataattggctatttactcaacaataaagagggaaaattgaagggtagttaattttctgttacaataacagaaaactgaaaattgaatacctgaaatggatttaatattaatattaattttaatattaatattttattattaaacaaatatttaattatatttctgttaatatttaatattaacaaataaatttggtccaaaaattaatcaatcgatcatttgaccaaatccgaagccgaagccgagccgcgcagcgagcgacgacgcgcgaggcttgccttcttctcaactctttaagagctagaagaagagcaattgcttatatacccataaaatcttttcctcttccgatatgggcacaatcaagagggaacttcaatattactcaaatatttattttccctccatttccattcaccctattttaagcttattaatcttaaaacccaacaatccccacatgaatggggaatggctatatcacaggaatatgcatgaaaaatgtgtgattcgcaagcaaggattaattgcatctggataagtaggtttccctttgaactttccgtagtgaacttatgtcggatatactcgatcaatcggtagatttgatatctttgaaccgtcgaactttggtgtatacctagacaacacaagtcacacaaccaacccttaaccgtctttggttctcattgttgtgttcgtttcagccatgaacaccgcctggtttcataagtgctagagaactggccttcaaattctccttgaagcggctaacacttcacacttacataggtgattcctaaacgtgtcatcccgtagatacactatttgatataccccgtatcaaatttagaaatcattaaaaaccttaatgctttatccttggtactgaacattgtctcatcacgagaatggaccaaaagtttagttgacaatgttgaaccgtcattaatgactttgtttgatctccttgaacctagatcttgggatctccagtcttctaggtagagttaccgccactatgacttgttctcggccatagtccattccccttgatgatttctcaactacctctctagttaggccttttgtaagtggatccgacacattatcacttgactttacatagtcaatcgtgataattcctctagagagtaattgcctaacggttttatgtcttcgtcgtatatgacgagatttaccgttatacataacgctcagcccttccaattgcccttgactatcgcaatgtatgcatattggtgccaacggtttgggccaaaatggaatatcttccaagaaattcggagccattcagcttcttcaccggctttatctaaggctatgaactcagcctccttgtagagcgggcaatacaagtttgtttggacgacttccaagataccgctcctccaccaatagtgaatacatatccacttgtggacttgaatcagttgatccggtgatccaatttgcatcacagtatccctcaatgacctgcaggatatttactgtagtgcaaagcaaagtcctgggtatgtactaaatacccaaaactcgtttcatggccatccaatgagattgacctggattgctcgtatatcgactcaatttacttatagcacaagctatatctggtcgtgtacaattcatgatgtacattaagcatcccaacacacgagcataatccaattgtgatatgctttggcctttgttctttgctaatgcaagattcacagtgttttttgcaactttaaagcccaagtgcttgaatttttcaagtactgtcttaatataatgagattgtgacaatgccagaccttgagaagtcttatggatcttaattcccagaattaaatcagcaactcccaagtctttcatatcaaacttgcagttagcaatcgcttagtcgcatttatgttggcaatgtcattactcattatcagcatatcatccacatataagcaaacaatgactatgtgatttggaacatttttaatgtacacacatttatcacattcatttattttaaaaccatttgacaaattgtttggtcaaatttcgcatgccattgtttgggtgcttgttttagtccgtaaagggacttaacaagtctacataccttcttttctttacctggaaccacaaacccttcaggttgttccatgtagatttttcctccaactctccatttaagaaggcgtcttaacatccatttgatgaatttcaagaccataaactgcagctaagctactaacgttcgtatggacgtaattcttgtaactggagagtatgtatcgaaatagtcaagaccttctcgttgtctataccctttgaccacaagtcttgccttaaatttgtcaatagtgccatcatctttcattttcctcttaaagatccatttagaacccaacggtttatttccaggaggaagatcaaccaattcccatgtatggttgttcaatatggattctatttcactattgactgcctctttccaaaacaatgattccgaagaagacatagcttctttaaatgtttgaggctcattttccaataagaaagtcacaaaatctggtccaaatgaagtagacgttctttgacgtttactacgtcttggatcctcctgttaagttactttcttttgtttcttcccgaggtctttagatccttcaccaatcgactcacattcctttttatacggatatatattttaaagaactcagcattatctgattctataaccgtattattatgaatgtcggattttctgatttatgaaccagaaatcgatatgctttactattagtcgcatatcctatgaaaacacaatcaacgttttcggtcctatttttacccttttgggtttaggaacttgcacttttgccaaacacccccactttaaaataattcaagttgggcttccttcctttccatttttcatatggaatggattgtgttttgctatgggactcgatttagtattcgtagccgtaagaacggcttcccccacaagttctgtggcaaaccagaacttatcaataagcgttcatcatctcctttaatgaacgattctttcttttcgcaatcccattggattggggcgtgaaggggccttgtttgatgaataattccatattctaaacatattttcaaaaggagattcatattcaccacccctatcacttcttatcattttgattttcttgttaagttgtgtttcaacttcatttttgtattgcttgaatgcgtctattgcttcatctttactattaagtaagtaaacatagcaatatcgagtactatcgtcaataaaagttatgaaatacttctttccacccgagatggtattgacttcatgtcacaaatatctgtgtgaattaagtctaaaggatttgaattcctttcaactgacttataaggatgtttaacatacttagattccacacatacttgacattttgatttgtacattcaaacttaggcaatacttccaaattaatcattttcgcaaggttttataattgacatgacccaaacgtatatgccataattcatttgactcaagtaagtaagacgaagctgaaattttattattattttcaacaaccattacattcagcttgaaaaggccctcagtgaggtaaccttttcctacaaacatttcgttcttacttattacaaccttatcggaacaaaacacatttaaaacttcttaacaagaagtccagacaagactaaattcttcctaatctcgggaacatgaaggacgttgttcaaagtcaccactttgccggaagtcattttgagaaatatcttcccacatccttcaatcttggcctttgcagcatttcccatagaaatcgtctcatcgggtccaacaggagcataagtagcaaaagcttcttaacagcacaaacatggcgagtggctccagaatcaatccaccactctttaggattgcccaccaagttgcattcggaaagcatggcacacaagtcatcaaacatcatgcttttaaccatgtttgcttgacccttcttcttgtctttcttcggagcacgacactccgtagatttgtgtccgtttttccacagttgtagcaatttccactaaccgcttcttgcttgggttgtatttcggtccagaagccttcttcctcttttttttcttaacaatatttgctcccattattgttgagtttccacggcctctcttttcagcagctttttgtcctcttcgattctcaaccgaacaatgagatcttcaagggacatctccttgcgtttgtgtttcaagtagtttttgaagtccttccacaaggaggcaacttctcaatcatcgctgctacttggaatgcttcattgatgacaagaccttcaatgaaattctgttagtaaaatataaattaatactaccaacatagtattaattattataccttcagcaaggagatcgtgaataatcacttgcaattcctggacttgggtaataacagacttgctatctaccattttgtagtccaaaaactttgcagcaacaacttcttaacccgcatcttcagttttgtatttcttttcaagcgcatccacagttctttgacgtttcacgccactgtagacgttatacaaagcatcctccagcccgcttagaatataattcttgcacaaaaaatctgaatgcttccacgcctcaatcacgagaaagcgttcagtttctggagtttcatcgagccaagaacaggactcttccttgatgaacttctggagacttagagtagtcagtagaagaacatcttttgctgccagcgcttgaaatcaatcccgaaaatttttcgggtttctccgccggtgccaatctgccggtgttgttcggctgttgaggcagtagtaccatcggaacagcttggttccgtttcattatcatttctgtaaaagaatgacacaaacgttaaaatcacgtagattttaatctccaatgaagcaaaaaccacaaaggttttactctcaaaacttgagtataacaaatacagaaaaatattaaattccttaagcttgttatatctgtatttgtaaaaattctggaataaataaataacataaacagaaatgtaaagaaataaaaaaaccaattcgagcccactgaattcacagtgtttccttaaggaatttaatcccctcctagtacccaaggttatggattatttcctccaggatagaacgaattacacactggtgtagtggtacttcaaaccccagtgtttcagcgaacacaaagttcggtagcaaatcaacttactgttgcttctttgagtaaaatatgcagaagaaggagaagaatcagaaaattgtatgaaaattctgagcagaatagcttgtatttatagccaaagttgggctgaaatctgaagaggctgtttttgaaaacggtccacgaataaatgccattacataaatggttatttactcaacaataaagagggaaaattgaagaggtagttaattttctgttacaaaacagaaaatgaaaattgaatatgaatgatttaatttaacaatatttatatatttctgttaatatttaatattacaaataatttggtccaaaattaaattaatcgaccaagccgaagccgagccgaggcgagcgagcgacatgacgacggagcgcgaggcttgccttcttctcaactcttttaagagctagaagaagagcaattgcttatatatccatcaaaaatcttttcctcttcacatattggacaatcaatgagagaacctcaaatattactcaaatattttatttttccctccatttccattcaccctatttaagcttattaatgcttaaaaccctaacaaaattaacacatgaaatttttgtcattcttttgtattcaatttttaagtggcaataagagatcattcaaatgatgggtttcggttggaacatatatgcgccaaggagcggagctagagtgccgaagtgggttcgtccaaaccagtagctttagttggaatcctgtagttgtcttacagattctatagaatacgtataaattattatttagaaccagtaacttcaaacgattagaatcccaaacccatcagcttgaaatactggctccgcctctttatgcgcctcgtataaatattagggcagtactaaataaattgagtgggagattctgctatcaacaagctattgctacattcatttcattaggaattgatgatcttttaacggtaccttatagagaaaaatactaactatatgggaatgcacacgcggaagaaaattatgtcagtccatttatatatgtatattacaagtgagtatttgcatcggaaaataaatccaaaaatttctttggaataatactcgatttgatagagtaaagggcagcctagtgcactaagctcgcatttctgcaagaggcgatttgataagagtatcacatattatctgctagaatattatgtaataacaagaatttcttcttcttccctactatcttaatcaatatggatttgaagtggttatatatctatatattaaaggtagcgcagtgcactaagctttcgctatgcgcacggtttggggaaagccggacgataagggttcaatgtaggcaaacttgccctgcatttctgcaagaggttgtttccacggtttgaaggtcacttggcagcaactttactgcgattggggaatgccagaccacaatggtctattgtacgcaaacttaccttgcatttctgcaagaggctgtttccacggcttgaaccgagacctcctggtcatatggcagcaactttactgcgatttggggaaagctggaccacaaggatctattatacgtaaattatcttgcgtttctgtaataggctgtttccacagcttgaatcgtaacttcctggtcaaatggcagcaactttactgcgatttgggaaagccggaccacaagggtttattgtacgcaaacttaccttgattttctgcaagagactgtttccttggcttgaacccgcgacctattgtcgaggtttgagaggctttccatcattaacaagacaatcattatatttaagtctcctaaaaattgtagtgactgaaaatttatttttaatatatctgccaaataaaaatgaacgaagggacaaatatcatagacggatcaaagatttaagcatatttaagaaggttcttagcactagacgcataatgcaagtgttgaacatataaattcaggcactttggaacaataaaggtccaccagtatataggcaaaagcccatggtactttttattacttcctccgttgacttttatttgttgactattagattttatacactcattaaaaaataataaataaatatataatttatcatgatactcatatttaattgatgcatattttaaatggttttgaaaaaaatgatttgacatgagtaattaatactgagggtataacaggaaaaaagaaattgtattctcttgatatgctaaaaatgacaagtaaaagtaaaaatctatttctagaatacaggacaagtaaaaatgaacgaatggagtattatttattattgttgaagatttaactcaaatagctgcccgctcgaccacttaaactaaaataaactatatatatatactatatatacataattcatatataatatatataaaatcgtgtataatctatatatatatcagctaaaaaaaataaatcggtaaatatcaccgtataatcgtgcatataaagatctcaaatttatttggagcaagcaaaagattcttaattatggtaaaataggaacaaatttaatgagggatttatgtcttaccatgcaggtatagtaattccttagcgggagtaataatgtattttttcttgggaattagggctatttcttgaatagcaccaccttctttagctagttccaatgcatgattaatttgaatcactgtaatataaataaatattactactaataaaaaaacttaaacattcaaaatagttaattaattggaattaaggggaaaaaattccaaaaaattaacctaagaaagatcctacttagaatatatcaggatacatgcatggtatgatttaaatgcaataaccaaagcttaagaaattacaacttacacttcttttctggaattttttattattttttttgttaataaatttacatggaagcttcagaagttataggggcttgaataaaaaaatcagcaattttttttttgttttaaaaaaatatttaactattattttttaaatagttttacattgtcaggtcagtttacatgttgtaacaaatattttaactttttttcaaaattacaaatccactttacatgagagatacttgtaaatattatttttttaataatctgatcgcctaaaaattcaattacatagtcagtgtatataagttaaactcctaaaagaagcaagaaaaccacatagaccataaaaatgctgcgttcaccactcattgtcatttagttgtattcttcaacgtgaaactgcaaataaaaccaaaaaaaaaaaaaatgaaaacctaatttagaaattatgaagtaggaaaaaaggaggaaactagagggaaaaaaaaagtacttcctccgtttttgagttgtttgtctcggcacggagtttaagaagaaaaaaaaagacttttgaaatttgtgatcttaaaaacttaaagggtaaaagttttgtgggtcatcacatttgtgtggttataaaagcttctcgttaagggtaaaatggtaaaatgaaaagtttaaagttaaattatttctaaatttagaaatatgtcatttattttggaacagacaaaaataaaaagtacctcatctaatatgaaacggatggagttagtaatatctggtgatgaatataaagcaattcatattatagagtttgtactttgtagcagcagtaagatgaggaagtgaaatttaagttttactaagttacaatacgaagctaaaacataaagtgaagatacgtaaatcttaagaagggtggagaaatttatagtgtccacagaaggaatataatattgaccgggcaagttgttgtgcggagaatgaataaggtggatttttccatggtcctcgtcatctgaatcaattctaaacgaacagtacctctatctggctttgttattattacagtgttatctgcaccaccagtaagtagagatatggagagagggacagctttgtcgcggacctttctttggtttcttttatgaattccactggtcgtccatggattataagggcttcccattgtatataaataaactttcgtatcctactctgcaaatcccattttccttaagcatatagaaatctatgattcaaattttcatatgctgctggtttggtgagtttagtgatcatggctggctcgcctgatctatcagctgagtagtaagcctctttgagataattatcagtatctcttcctatcaaaatgagattaggagggcgccctttttaaagagtttcagagcctcagtcatgcaaaagctaaattcttttgaagaagttcaattaatcaacaagaacctattcaactgctgtaaaatgcattgaattctttcaccttttgctcatttaatttttcttaatggttttggttatttacagcttcaaagtgtcactatatttccctgcaaaaatcaagaatctgaactttgtcgctaaattattcgtagccaataaaacttcttgataatatgtcattaattcgtagctaaataggataacgacagatttaactgtttagttcggtgcacaaagcatctcgcgttcagttcatgcaagattcgtggaaggactgtatccctaaggagtgtagtagacaacctaccctaatgcacgaattagtggttaattccacggctcggacccgtgacctataggttacacggagacacttaaccgttgctccaagatttttcctaccttttttagtagtgatttttcattaattaactcatcatgcatgcataatgaaataggtcgtagagaaatgactgcactttaataagataagaaatcaagcaaccttaggttggcaaaaatatttgatttcatatatggagatcaaccgttgaagccactacaggaaataaggactacgacgacattaaattagcgaccatatgataaatgtggaagaaaagttaaaaaatttcacatcttttaaaaaactagctttggtgtacgtgcaactgtgttcatggtttggtttggatcgattttttcctaaaacgaaatcaaatcaagtaagtcggttcttaaaatgttggaatcaaaccaaaccaattaagtcggtttttagtgattcggtttttgttgttttataagtttttcgatttttttaatcgttacgcctttcgtgcgggtcggaacttacccgacaagaaatttcactatcttaggacattatgcctagcattgaaaagactaggtattcacgtacttagtactggtgccacagagagatatgtttttagatctcgcattgaaaaaccacatgggtggatatatatatgaatccaaatctgccggctcgtcggcctgcttctgcacaaggcccctgcagaggaaaggctttatcccagtgaatagaagatactcagctccgcataacaagggattagcacactttcgggaagaacatagaatagtagaagttggttatttatcggttttttcttaaatatgagacatacactaccaaacacatattccacagcgactacattttcaacgtaacactaacgaaccaattgttcttgagaaatctatcatttaccgtgatatattgatgataaatgaatcaaatagtgatgaataatttaagtcaattaaaaatcaattatttttaatatgaaataattcttgtatttagtgaaagcaaactaccaatcaaattaaaatgcaaaggcaaaatattatattattgtaattgcaaagaactagatataaaataattcttgtatttagtgaaagcaaactaccaatcaaactaaaatgcaaaggcaaaatattatattattgtaattgcaaagaactagactaaaatataaatgactaatatataacataacattttagaaacttatatatattggtgtaataataaatttaagtagctatttttatagtcggtttagatcggtttttttgggttattttttattaaaaccatagccaaaccaactttgatcggttttttgaaattcaaagccaaaaccaaaccaaacctaaaaaatatcgatttttttggtcggtttagtttggttttcgatttggttcggtttttcggatttttatgaacaccactagttgcacgtatgattagcgtcaatcagtaaaaaatgagttatgatagaaaacatgtaaatcaagttattaaatgctaagttttcctttaaaataagtaactttatactgaaagtatagggattgtcatttatttaaacgaagaccagaaagaaaattaattaatgacaactaacttagaatatattttgtcttctaatgtttcattcttattgtttttaacgtttgcattttaacagtttgactcttactactatattatattggtgtgcctattatattttcaattttattatatatattgaaaagtatgggttggatttttcgcaaattagttaaatcaaatacttttttggttaattagaattgttctttgtccccccaacccctgatggcaatgctcttggtgagtcatttcgtctttcacgatcgatggaacgttaaagagattcttttgttattgattcaaatcttaataatagcttatcctaagttttaaatatttaattgtaattataatttttatctaatatgaattttacgttcaatataataaaaaaaccgttcttggtacgtgtatcgcgcgtgtatcttatctgagtatttgggttatgaataaaagtataagttccccacaatagtcattaatattggcaacgtataattaactcaattaagaaaaaaacgtctcatagaaatccccagtcgccagttaataattcaacttaaaatttatgccacttttttaataaataaagttagcatgcttccttttcagtttaagtcttaaaacatgtaataaataagatacttaggtcaattattagttgttgagcgaccgtgctaaaaccacggaactcgggagtacctaacaccttctctcggtgttaacagaattctggtcttctggtttcgcacactttaaaacaaagtcaaatttcctctatttgggatttaaaattaacaggtgaattgggacaccataacaaatatcccaagtagcgactctgaaataaataaataattcatttcgattaatgtcacttaattggaaaaactcccctatcctttcggggaaaaggaggtgtgacaataataattaatatatataaaaataaataaataaaaataaaaagaaatgagccaaagatgtgtgcaaaataagattatgaaaaaaaggaaatatatttattttttgaaataataataataataaataaaattaaaaaagaaaaaaataaaataaaaaaagagaagagaaaataattgtaatgtataatttattttaataattgaataaaaataaaaaaagataaaatgtaattataccagttatattaaaaaaatgtgaacaaatattttctgtacgggtatgtaacatttgtgactatgtgtgaaaactacttgtatttagtcacaatctgaatagattctacagaataataagcaaaccatggtgtagggtgtttatcaattaagtttatcaacttgggagattattttgcatactcagaagcaataaattatcctcataaactattaaattaaaatgagaaaaaccacttttctattggataaatcttatggaacaatgacgtctcaaacttagaaaaataaatcagttataagtacctaatttttgccgtacagaaaatattcctataaaattctcaaaaaaataattttttcctatttgttttaaatttatagaattttagaatttttcttttaaattgactgtatgcatttagttgcattttcatgcatgtttaatattttaaaatcatagaaaaatcataaaatttgtcacattttttatttcatgtcattctaggtttaatttgcattttaggaattaattactctttaattgatagattaacatataaaaagtcacaaaaaatatacattagcattaatgaattagtctaattaattagttaaaatgctaagtaggtctttttttacaaaaataaatttaattagtagtaatgtggccatttttgtaagaacaaatttgtcttttatttcaaattggcccaatttcagggcccaaaatcgatcggcccaatatcttaaaagacctacctggcccaatgcccattccctcgcattaataaatccgtaaaaattgcgcggggcgacaaaatacctatacccatatttttaaaattatttaacctataccctaatttttacaacttcaggcgccgctttcctaatacctatgcaaaacttctgaagtttttacaaaagaactaaataacttcagcatcttctgctgaagttttttaaaaaagctttattgcaaaactaatgaatccaggacaaaacttcatcttatctagtgctgaagtcatttttacaaatgaacttaataacttcagcatcttctgctgaagtttttgaaaacgaactaaataacttcagcatcttctgctgaagtttttgaaaaagctttatgacaaaactaatcaattcaggacaaaacttcagcttatttagtgctgaagtttttacaaatgaactaaataacttgggcatcttctgctgaaattgttgaaaaagctttatgacaaaactaattaatctaggacaaaactttagcttatttagtgctgaaattttacaaatgaactaaataacttaagcaattctgttgaagtttttgaaaaagcctagaatgttgaagtttttgtgattgcctttgctacttcaggactgtaaacctgaagtttatgcgaaaaataggtatatttgcaatttttttacaaagtgagtataagctaaaatgtgacccacaaagcgcgtatagatgcaaaagccccaataaatccctaaccctatctgtaaaagaggaagatgtctgaaatccctacccaaaagagagaggagaacgacgcacccctcttcatcttcaacaaaaattgagaccctcccctttttttgaaaaacccagcagccttctcaaaagagaaggaacagactcctctcctatacgtaaaacctcgctgcgagagaataaagaaggctctaagctccagctataccaccccgtttccgccaggtacaccttcgctgattagaagcagaaatttcaaacaaaaaaaaacgtataaaagagggtatttgatgcttggatttgaggaacttttcatcaccattttctgggtttcattttgattttcgaccgaaggttaactctgtttgctgccgattttgcttctgctgatttccaatttaccaattcccggcatgtattcggcctctcgtttcttctaagtttagttcttgagcagagaggtacgatcatcacaaaaatattctgaatatccgttttcgttaataaatcatgatgtcatttggttcatgtattgttattgctggcctttattcgtctagatctgattccaaacagtgcggtcaaaaagggaatctgatagctggttaaatccgaggtgctagattttggttgttcgtgcaaattggtcattgttgtaaagataaattttggttgttcgattagtaataaaataaacacgtcgcaaatcatttcatgtggcgcggttcgcaacatgtaccaaatcgacaagcgtacgacatcgtgacttgtttcaaaaaataaattccttaaatactaaataattaggccaattattaatagttaagcgaccgtgctaaaaccacggaattcgggagtgcctaatgccttctcccgagttaacataattccttacctgatctggttttctgctaaattatttcaagtggcgactttgaaaaattaataaataatcccaaattcgattatatcacttaaattggaaaaacaccctaagagatgtgacaattatataaataaaaaataaaaagaggaaaaaatgtaaatgaaattacattatgaaaaaagaaattaaagaaaaaataagttaaatgaaattagaaaaagaacagaaaaaattaaaagaaaacaaaaggataaaaaataataaagaatgagccaaaattaagagtgaaattaaattatggtaatatataataatatgacttggacaaaaaataaatggagaaaaaagagagaagaaaacagaaaaagaaaaaagaaaaagagaataataagaaaagaaggaaaaaagaaaagaagaagtagagaaattaaaagaaaaggagaaaaaagaggaaaattaattagtttgatgggtataaaagtaaatgaataagcaaagataaataattttatttttgttagttaattgtgtctcaccctattaaaatcacataatacccgcgtctttgttttctctacagttgtataaagagccggctaaaaccctaatttgaaaaccccattgagtgcataaaccctttggatcatctgcccttttggttttccatattgcaatggagcaccaacgagcaagaataggcggtgaacagcaggaggacacatcagcgacgacgcagaagaaaaaacgtaaagaagttgctctgtatggtaactacagaaactactatggctatagagtaagcctttctcttctccctctttctctattttacatacccttactatttcttgtttggtttgtggctgctaatggatgagttttgcattaaattccatgtaaggaaataaatcccatctatgcaaaaccttaaaccttggtgagtatagttacctggggagtgttacaccgtatcttcataagcatagttactatgtaatgtaggggtggaatcactagcggaaccgggaatttatacaaggggattcaaaaatattctaggatgttactgttgtaatttgaacatatgacctaaagcaaatttgaaccccccctaactactgttcttgtatttttcatgtcaaggggattcagcatctcacatataaccaaaaaatattaattttactctatttacattgtgtaattttccactgacaacacccttcactctacctagttccgcccatgggtggaataggtaaggtgattttatgcttagatacccacaattatatgaaaaacccccatcttaggtattgtttgatatggctcatgactagtaaggcagggaatatagttgtgattttatgccgaacgctttattaaagaatacatgattcaagttaataattcttttgttgatgaatagatctaatgtcggaaaggagagctcttacagaggaaaataatctttattgtaaggaaaaatattcttattttcctcttttaccaactgaccctctctttagcacagatggattgtagtttttaggggcgaaggtaagacactaaaattttttccctaacagtcttaaggtagtttcagcaactctaaagtttttttgaatcagaaacatacttgttttgttcataaaacaaagttgtctttcaaaagaacaaaatagaacatttctatagaccagagtaacacctttgaataaaaaaaccaaatttactttcttttcttaaattaatttttattattcttttgttttttgttgttattattacattggggacgggcgaacggtaaaggggaaggaaatgttatgtatgggattggaaccatccgactacaaggtggaaggtgagtctgcttaccaagtgagctgatccccacgagaagttcacggtgcttagcattgtcgattttagtgctccctaaaacattgtccggggagatgtggtcttttgaggttccaattgttctgttcctcaaaatattcgcatacattatcttttttttttttaaaaatattcatctgcctccgtccacctttatatttttttccaataacgcacataagcagtctaagaaattaatcaattttatttaaacatgaataaagaatgaagtttcttccgatttagtaaatttctttggaggtgggagtttgaaacatttattattttcttgtcactttctacatattaatgtatggaagaatttcggtaagacttgtatgtatctaatctaatggaagggacatcatctccagctaaatttaggtttctattgcatgtgctatctccggaaaatcttacggctcccaagttgaagcaatttgggagcagctcagagtttcttttttgttttgttaccttttagtttttttttaatttttttttgttcaatatcgtaagtccagatataattttgagcaagttcatcgctgcataccttttagtaggactctcactatttggtattttttgtgcacagaatggtaagatttggaagaagatccaaggttaaaagctatgaagaaggagtggtttgaaggcaaggattgtcttgatattggctgtaatagtggagtgatcacaattgccattggtaaaagtttcttattgcatatatgtttctgaattgagatttctccttaatgtttagttgcatgtgggatttttgcttgatatctccgctaacattgtccaccaatagaggttacacatttccttttcttttgtgtgttgttaatatcagttatccttttttgactacagcacgaaagtttagctgccgaagcatccttgaattgacattgatggtggtaagtatttgaacttttcatttggtctacatatttggttcacatgtagttgattattgccggaagaaatcacgagctgattaagatgccaacaaattgtcatgcaatttgtgaacggcacaaatgttactttcatggatcaatctttattagagagcagctgaacgggagtttgttagtatttgaattttgaacccacatagtgcattttgttgatttttcctgtgcaattggatggaccaaacaattgttttgtgcaatgattgtaatgtgcggttggtcggattgtcgtgtcacacggtcgctctttatttctttccttcttattattgtataaatttggcctcttgatctcttttgcaacttattaccatagttgccgataatatcatattctgttatccatataggcatcttaagtaatgtgtgatatgatggagttagcatttgactttgagttgctaggatgtagtttataacttttattctctcttttcacctcttccagcaagagttaatgatgcctattggactctcagaagagaagtgaagagtcttagaacagtgcctgcaggaggtgacaaattagcagaatcaaaaactgtaaattgttttaaaagacccggtggcagagtcacttaataaaagggcaaagaatgactgtacaacacctcatcatttgcaagagggagatttttttgacatagtctccttcaagaaaggagattttattcagaattggcatccaagagacaatacatcttatgatacaattatttggtaagttttctttttctttaacgtcatcttccctgcatggttcaagagatgtgaaatcttttagtcaattgcaatccttctgcgaaaaggtatccacgatttatattgttggaacttgtgtttccttttcaaaatcacccaaaattttattctaaagctgcatttcttttggcggtagaggaaaattatgtaagcagaacaagatgataaaagaacaagaacagtgcaaaagcttaaagggtttattagctggagaacattttctgtttcgttatcttgacatccaactttgaccagtcctaggtgagtatgatttgggtggattctgtcttccttgttttccattagctccagtcctatctgtgacaccacaaagacatggttaaaagaggcgaacaaagagacttttatggactctcatgcttatgaatatcatttttatttatagaaagttaatatttatattcatcaacactcaaaatagggcttttactagtacagaacctctcagatttacagcgagtcaaaaaagtctagtactgattctgcatcacctaccaattgttctttaaaccaaaaatgaaaaagagaaatgaatgaatattgattttttgtgttgaagtactcttgccttcaaaacattttgcattcatctcttttcaaactgtccaccatatgcaagccgaaatcttccaccattccttgtgacaggttcttcccctgatactgttccaactgcatatcaagccaacggccttcttgggcatcatccaaacaatactagctagtgttatgaagtgctgccaaagttgtctagtaataacactattcaagaatagatggtcattggtatcaatttcctggtgatagcatgtaaagctggtctgaatacctcttcttaggagaattcaaagtgagacaggctcctaccatcaaccatgaaaaacaagtaacttcgaatagtgctttgatcatccaaatccttttccaaggtcaggaatgctgggttagtgtttttgagagcgagaagcgcaaaaatgctacaggggcttgcctcgctttaaaagcgaagcgcacccttcattgaagtgaagcacaactcttaaaaaacataaagtaaactatgcaaaacgacaatataaataatcaaaaagctcaatttaaaaacttaaaagtaggtaccacaaaatccttcataaaccattcaataagcaaaatcaaaaccccttaattactaggatcaacatcttattcttctactcttctagttcttcaagattgtcaaaatcttgaattcctctattttcttcatattgctcgtcagcttcttcttctttctcttcatgatcactttcaccttcatcaattagggatcgacttgtagtacccactctttcccttcctattcgaattcgagcttgaacttgaagtattcccccttaaaccttaagggttctccccaactccactagcctccgcaacatcaccccaagtgaaattacaggcgccttcaaatacttcttaatcttcagaatttttgtgggacttcgattatccactcattagcctcataaatattgtccaaaagaatagtatcaattagattgctgtggttgtagcgacgcctcaatgctttattgtattttataaacactagattattgaggtgcttcaaggctagaagattcctcttcgttgtatgaatctgcaaacaagatgtgtcaactaatttgtaggagtttgacaattgagatataatttactttatctcactactcgaaatcattctttttaagtctcacatgttcaaaaacgctccacttcctttcacatcccactaagctacaagttaaacttagaactttgatggagaaagtctataaaaccggagtcttcaaaccatatttgtttcaccactcacctatagaagtgaaaaaatattcaagagtcaataagtataaaaaatacattaaaagttagagctataaaatatagaagcatttggtcacctggggtcttcgtcctttctttgtttaataaccattcgcagcttagaaagtccttgatctgccttgtaaataacaagatgatctattgtattttcttctagctcattatcttgggccaacttaataacacagtcatggaatcccttccatacttttctatccagtgaattattctcatatttatcataaaagagtgacgggttccgaatatgtccagcctcatgcaaaggtcgatgaggttgctctgtccatcttgaatcaatgatctgaaagatctttgtttaatagcctccttggccctatccatagcttcatagaggtagcctattggtggtttttgctccccatccaccaaactctaatcaaagggccaccactttcaagagcatgaaggacaataagaaagaataatgcgtgcagctccccaccccccactaactaaaataggaaaaaaaattctagtatgaatgggatactaactaacaatcctagtttgactagaactacaaagacaattctactaaaataagaattaaattactaggaaataagtaataagaaatcctaatctttaaggaaaataattcctaatcttgaatgggttcttaaattttttggattcttggccttcttgattttgcatcattctcccctggttgaaaaagattggtcctcgagtctaacaacttccaaagatgggacaagatttgctataatatgaatgggtatccaatgctcaccaggtttcaagttacattttgctagcttattatagagcctattcacgttacaagaaaactctggcatgtggtcgaactaaatcccactttctaagtttcaattttctaccaaatcttctccaagtaatcttatttcttatttcctagtactttaattcttgtttttgaatcgtattccataataagggtcgttgagcaatataagaatgtatcctaacacccttggccaaaaattgtagagaagggttttttcttcaaaatgtctttgaaaattaagttgatacaatgagccgcacatggagtccaatagatattcgggttcgctccttgcgccataccacccgctttaacatttttacccgcattatcagtgaccgcttgaacaatattgcttgagccaatcttttcaatggtgttctgcaacaagacaaacattttgatttggtcagtggacgcgtcgctagcatcaatcgacccaagaaacaaacttcctttgggagaattcaccaactcgtcattaatcatttttccagttcttgccgtcgacttattcatcgtaatgaagcatccatacttgttccacacaactttatgttcctttacaattttattggtctcctccactttcttatataaataaggacctctgattccgtgataatgggaggagggggggggggttcattcttggtccatattgagcaacgttctcaagaaagtctccaaaagtgtcagtatagttggcacaattgaaggggagccctacatcattgacccatcgtgcaaaagctataaatgcacgatcccttaaaatgtccttggcaatttttgcaaatcttttccaccgctcttttcttctgtacgtctttgggaaaataacaatctataggacctttagtcctactcatacccgtcgatccatggcttaaagattgcatctcttccccttttttgtactttgttggaagtgacaaatacagcttcatattcttcctatcatcactcatcatcatcaagattggtcacaaatggttgatgactcatttgattttttacctccttttcaacaaaattctttatttcttccctcacctccggaggcatttgtgacaacttgtgacatttctatgccaccattaagtggaatttaaagcataaattcccccgttgtaatcttgttacaaaacttgcattaacattttgctattcttctcattaactttatcgccatatcaccaagccgagcgtttctcttttcgaactttgagacattttaatccctattatgatataagaaaacaaacataatgaaaatatatataaaatctttgttgtttcttttgtgttttttcctttattttatctccagcttaatttaacttcaatatccactggtcatgtatttatttgtttatttctttgataagtcaatatttcaaacataaactcctactcggcgtcaaatatatgtacacagggtaataagctatgttgttaggacttgggtgtaggtatccgacccgggtgcggatctagaggtcggatccttcataatctaaattttaaggggtatggatccacccacaaatatggtgcggggatttcactaaaataattcaaaattttaaaagtagatctataaaaatatcctaaattatgacaaatatttcgtaaaaaaacttataggctgtggagagcagccaatatttatctcccattttgagaatttttcaagttataggcactaggcactagagtagtatgtagcagctaaaattctatctattttcatttgttctcaaatttgtccatggattgttggtcaaagtatccgattcgattgaccacaccctgtacgaatctcacacccttatcaataagtgtcgtgtcgacacaagtgcgacgactaaaatgaagagtctgctcaacataagtaataagtgattctaactaagttatatgccattatgttctagtagtgtttagtatgcgacaattttgagatcaacttcattagtcttctaaattttattgtgggatctttctttttcttttctttcttggggaatgggaaatttggccctgagtcttggggctaggtgtaggcttctcaatctttggcttttctaaagattgatcagcacttgaatccctcattgagggtttcttacggagaagattagacccgttttttgcttttctgtatgtcatatgttttttagtattggtcacttttcatgaagttgggtgctgaaattttattctatttccatgtatgtgagcttgaagagctgaatttcattggatgcagcttaagcgtgtcaaagtgggtgcatttaaacgggggagatgacggactaatagctttgttttccaaagtctggaggctcctttcaccggtaatgttcacgtttaataggaagaattccttgaaaacagaaagaaactcatgttttaactgtacttttttgatagcagggtggtgtgtttattttggagcctcagccttggaaatcatactacgagaatcgtcttgtatctgaggtatatcctttcatatattactggcttcacatgcgtgcttactatacggagaagaccttatattgggatttcttttttactttgcgtaccaaattgtaaatgttcatgttgttcttgctatgcagacaacaagaattaattatcaaatattaagatccgcccagaagttttcaagacatacttttggacaaggtatgttgcagggaattctataaccctctccctccctccctccgcccagaatatttcatgactctgggtaggcttcactgacacatccctttaatctgaatgcagattggatttagaatggtagaggacataacatctagtgtatctggttgcaaaactggctttaaaagcctattttggcattctggaagtgatgtgttaagttatgaaattgcttttttgtttgactgaaaattagtgttgtatatatgtggattccagtagggagctattacatgcttaaaacaagtttgggattggctctaatacatcttattctcatccagaatcatcagagtttggacaaactgtctagaaattccaattttcaattattatcttttataagctcttcttaatttctttttcagaattagcattaccaccaccttgaccaaacaaatgcagacttatgatcttttagcgatttaaagcttaccctacgttgttgaaatcctctcatacccaaacaactgcagacttattaatagatgttttatattaactagtcttatggtacgcagcctctctacctcatgatagggataaggtctgcgtacacactaccctcccagatctactagtgggattatattgggttgttgttgttgttgttgttcttgttgatgttgttgtagtcttatggtacgcgttatgcgcgtgtaccatgtcagtgagtatataattttttaagaaatcgcataaatattattaataatatatttgtattaaaataattttaaaaaatataagttcctaaaaattatgtacatttatcctatttagctagctcgataaataaagtaatatgatttattgcaattttatttccgccaatgaccgaagtaatctgaaggtaacttgacttgaagatgcaactacctaagaatgatgatttcctaaccacccctttcaaacctttctatgcatgtgttgtgtatataacaaaataattttttcgtatttgcctaaattttgatgagcggagtttttcaattaagtattttgatgaaatactcgagatgcatacaaattgacccgacaccactatcataaaataaattatacaataaatcaatgattttccaacacaatagttcatagaatgacatggaaaagatcatcagtattaagaaaacaaattcgatattgatagtacttgtacaaacaaatggataactttagacttaccagaaaaatatagaactcagattttcatttgaaaataaaatagtgactctaatattttctccaaaacaaaacaataagaaagaatcgctcaaaggtgtaacaaccctgccagtcattctgtagaatttgccccgttattttttttttgccttgtcatgcattgtttaggctgtttatgatgtgttggggtcgatttgttcgggttcggagtggttgtggtgagaactgaggcacttagtctcttaaattagccttatagttggaaaagtcaactgggagttgacttcttggtaagcgacctcggaatgtagatcttatggctcgtatacttcgttaggtgatttgagacttaggagtgtgttcggaatgtggttttgaggtccggtgtagaattaggcttgaattggcgaaaattagttttggcgattttcggccggcagtgaaaaataggctatcggggtccgggagttggagcatgtccgtagtgccattttggacgtgtgtgtaaattttcagatcattcggatgtgttttggttgatttcgacatcgttggcgattttcagaagttttaggaatcttaggcttgaatcatgggttgaattggagtttcgatgttgttttgggtgttccgcggctcgactaagtccgagtaatcatttatgacttgtttgtgtttttggttggggtaccgagggctcggttgcttttggatagccctcggggcttagaagttggaaaaatgcagctgaagtgctgctggcgctgcccatctggtgtggtcgcacctgcggatgcatgagcgcaggtgcggaagttgggcatctgagtgttttccgcaggtgcgcacctggaccgcaggtgcgggtccgtaggtgcgcgtaattggccgcaggtgcggatatccctgggcagatcatataaaaagggtccttagcgaattttggtctttctatcaccattttcatacgggttgaagcttttgaagcttttgaggtattttgggtgactcccatgatgttgagatgagttgctcgagtggcttgagaggctgactgagtgaggccgagagccgagtttgtgaggatagttatggatcgggctgcacgccgcagcagtatagcgcttgggcttaggatcccctcgcggagtctgtacacccccagtgagcgcagtcaactatatatttattggatcgggctgcacgccgtagcatatgttatttgaatcgggttgcacgctgcaacatattttaggtagatcgggctgcacgccgcagtagtaatgtgggtatctggtacttgttgagtgagagtactgagtgtgagcatggaattattatagggagtcacgagtgactgagaaaccttgttatgagtgatactgtgccagaaaggctgttacattgttaagtttattatttttctcacacttcttattactgagccttcctaataaagttgaactactgtttttattaaattatgatttgtaaatgctcgtcgctgcactcaagtttttagttactttggttacttacttagttggcgtactcacgttacttcctgcacctctgtgtgcagatccaggtaccgggccagctcgctagttgacttctcacgtcctttggagttgatcgaggatcgaggtagctgctcagcatccccagcttaccttctttcctttcccagttcatagacttttcatacttttggacctgtattagtagcaaagtcacatttttattcgttgtatttactgttagaggtgctcatgacagttgactccagaggtataggtcggtgttagagggctagtctagtttcacgataggctccatcacaaccctaattgattgggatcgtgacaaaaggatttatgttatggaaatatacatatataattacaaactcgatccatctttgaaatttcattgtaatagatctcgggagagagaattgatgttacgaagaaaaatctctaagaaaaagactgtctcaacctaatttttgtcaaatgcaaattgtatacggtcaaaatcggggaacctgatttcgatgatctaactactactccggatcgagtttggagaacttggagtagggtcgaggctggctggaaatgcatacctcgaggaacgaatcaaaggcccggcacggcctacctagagatagtaccattttgatgatactcaagaaagaacatgaatttctcagggcacaagatctagcatgagtttgggataagatttgtacgagttagtacaaatccatactaggttgttatacaattgtacaatagaaatctttatcataattagaaaatttaccatattagggttctcccctcctatataaaggggaccccaatcatttgtaaagatcatctcactactggcaaaagtatattctatcctacttttctcgtttattgtgctccaagaattgttcttcagctttattactcttactttatttttcttactttattactcttaacccacctcgaggcctccgagaatatctagcttgaggtcccattgctctagcaacactggtttggttcatcaattcttcttactatacttaatattacttgcttattcactagtattggaatagatcacgtatctttaaaatcaaaaatcaaatttaattattacttgtatttttcgaggtaaacagtttggcgcccaccgtgggctaaagataatagtgattattttagtgctagttttctgataatacacgttattcttcacattttttctagtcaaagattctttaatttcaggctaaaatagtctaactcaataaacgcaccagtacatggcaacgacagtctcggattccatagagaaaacaatgcaacaactttagggaccggtgtgccaccgcttaaaccctgggtagcaccaacccctaacctagtcgacgttggttcacacattgctttgaacgttgacttgggcattgatgttgaagaagtgtacgcggagaggaccatcccgatgcccaaaggacacaggctcgagaagaaagagaagccaatctacaagtgatttttgaaatgttgcaagcacaacaggttgctatcgcttagttgcaaagtcagcaaaaagactccgagcggacaggaccagaaaccgctcatggtgttgagccaaccccgagaaatcacgcaacaatgggtcgggagttgaccccaccattatgagatgatcgaggaactcactaagaggatcaagtggagagaaaaaaggattgaggacaacgataagaaggtggaaacatacaactcgaggtcgaccagataccgggagcaccttcgatattgaaaggactgcattcaaaaaagtttgtacaaaaactattcctcccgagtgcgcccctattcctaagaagtttcagatgccagacatcccaaaatacaatgggaccaccaatcccaacaagcacatcaccacatatactgtggtataaaaggaaatgatttgtaagacaatgagatcgagtttgttttgctaagaaagtttggggaaaatctatctaaaggggccatgatttggtatcataacctgccctcgaattctatcgattcgttactatgttggcagattcgtttgtgaaggcacatgttggtgcctaaaggttccaacaagaaagtccaatgtgttcaaatcaagcaaagggagaatgatatgttgagggaatttatgtcccgattccagttggaacgaatggagttaccaccagtctccgatgactggctgtacaagtcttactcaggggctaaataacgaagttcaatagcttcgaggcagttgaagcagaacttgatcgagtatccgccgtgacttggaggatgtacataaaaggtaccagtccaagattagggtcgaagatgaccattgggagtccctcgggctcggtctacccaagcatattgatagcaaaatgagagatgcagacagggagccaagaccaaataaggaaagatattagccattcatcgaagaccgaaggaacacttcgaggcgtaacatacctcggaatgatcgaaatttgtcatggggggaggtgaatatggttccttaggtcgtatttgatgtcccggacaaatattaggcgatccggttccggcttcgtcccagcgtcgggctttggccatggcaggcaaaaatacaggcacgactggcgaaattccaatcaacttcgaggctcaattcatatgtaacatagccaaatacgaattctcaccataacacatgcagaaccaggtttccaatgtgtcaaaattcccaagggcctcagggaccatggcaatgctcaaaccagaaccacatattagaaatgatccaacagagattgggaaccagttcctagtgcgtcagagttcacagaagtctcacatggaccctgagcagtgctcacactgggttgttgaggatagaacctaaggattaagagtggaagtttttaacatataaaacaaagtagagacagtttaaaacagttctgatttcaaaagaaaacaaagtttaatacatagaacttgtagcagaattgtaccaagagaacaagcaagattcatgatcaaacacacagttcaaataagttgaagtccggttaacagtctagttaactaactaggtattcagtgctagccttgtttaatcacagaagcaattaggcaaacaatcagattctcaaatgaattcagagagataccagacatgttagcaaacaaattgacagagcatatgaactaagtaacaagtctgtaaagttgctatgaattaactagttacatgttggtagtaccctaaaatgcaaagttcagaacaggtgcaggattaacaaataatgtgcatggacaagttaaacattaagctagttttaagaggattcatattattcaaagtataataattaacagtgtcactcacaggagatgaaatcatagaatcatataaaataacatcatcataatcagagttcaaacatgctgccggcagcaacacatattataaacatagaaatggaatgaaatgacaaggattatggctacttgctaatggatgtcccaaggatacgagattatgctaagatggcgacacaagatgttcatacatcggagaggtaaggatctcaatttcttaaagagactcgattcccacgttggccattccgactgacacgcactcatatgatagctgttaaggtatgttcttatgttactagacagtgagaaggtttcatgatgatatttgcaaggagtagagtgaccattcaaaccatagaatccatattcaccaatgagaagaagagtgactcgagaaggattgcaactcgggatgctttacatggaacatgacatcacataggtaaactttacgatggtgcatgcctaggaacaagtgagcagatgttgtctagatttggtaagaaatttatcggtatagtcccttgttgaaatttgggaaagcaagtgggaagtacttatactagagttataactcaattcaaggacatgattatagagctcaatcccataagaagttgtaaataagagaatttatgataaagtggagtcacgaatgatacgtctcgtttaaggagtaggtacatgcaatgttttgtgattcaacatcttgttaaggccatgtttatggaacccttcaatatatgtacaaatacaagaagtaaaacctttgtgtcattcatgatgacgcactaaggagtggcttacttagtgactttaggttgacagggcaacaacttaagcgatgcccctcgactctacgtacctaacacacgtgggtaccataatacttactacatggttgtggttacaacgacattaatagggacaaaggcactcctcttagaaacaggttctaccaatctctctatggctcgatacattctccttacaaacttttgggtaatccctctcggactcaatggtgggactcttcccttcttactacttcaaactcgcggactatgttatcaagattactcaccgtgagaataagacataggaaggaaattagctccctatcttgagctctaccgcacgatctggagtatcaaagaagggtgaaattcctaaatgctcaagtagcctcctaattatagatatggtcgacaaatcaccgataagaaggactctactagacacggctccgagacatcctaggaccctttaaaatcttaggctctgataccaagtttgtcacaccccaaaaccgaggggcgtgactgacgttcaaccgagtaaacctgattgagcaagcctgtttggtttcattctatccaaaataactcaggaataaagaggaggtgcactccactaatcacacttcgtaaataattcattagtaacttccatttttattttcattagcagtgtcagccaaattaaccaaattaatacaactgttttatgaagaaaacaaatttttgcaaataccaatatttccaattaaattcccaaaatcggacacacccacaaactgtctacggagcctttaaatacaactgaagagtatatggaaatgtcggcaacaaggctccggctatacctcaaatgaataactagtacaaagaggaaacatatactatgcatgaccctgggaggaaacggggctcaccaagactactgtgacaggagagaggatacgccgctagctgcgatgagccctatctgctaaggaactacctacatccatttaaatatgtagcgcccccggcaagagggacattagtaccatcgaatagtactagtatgtatgaacaaactccactctaaatagaataaacagtaaaaacaggtaggcaggcagtcatagaaatcaaatagcactttacaggaatagagaaaaacaagtaggggtcacatagtttcttatttcgtctttccatccttttgattaatagtcttttaatgctgagtgccacaacttataatgccaccatgtttttttacatggagtccggtctcggcccaaccggctaagccatcctaagtgagacatcaccacatccacaatttatatctatgtttccgacgtaaatgccaccatgtatacaacatggcctccaatctcagcctgatcggctaagccatctcacttgggacatcaccgtttcaattaattactcagttcacatctcatttccatcatttattacataattcttggcacttgatgcagtttacagttttagtctgtttcctttttattcgctcaataacattatcttccatattgataagaaccaacacataatacatttcacacataaaagaaagagcttgaagaatcttgattcacattttcaaatggcatggtgacatgataaacatctagaacaattagagaacatgatgcttacgatctaacacatcaaggcaatcagttcaagtatagtcaagtaagggactcacaccaaatattcagacaccaaagagtcaattctactaagaataaagttagccatacatgccttaattgagctttatttagtacttgtacttttagacgactatggtttagcagcctcaatctattcagtgatgtgagaatcatcttgatagccttcaaagactttagcaataattgatggatttagtgtggagatcatttcctttctcttatagctctcttcctccctctagaattctcagaaaaatggctcaaatggtgtttaataggtgtatttaacgggatagggtcgggttttaaaataaaaaatgaccgcataatgaagatacagcccacaaagtcatcgcagaaatggcgtcaggagtttaaaatttctgatcgcgtatgcggtcattatgcggcccgcatacctgttctgtggttgtatttttagaactcccctagcaaaagtccatggcagttgtcggcctgcatattcattatgcaaccgcataattggaccgcatatttggcctcaatttttggccaacttattgattcactctgcgtccattatacggtccgcataatgggccgcaaaaatgcactcagttaaaaatattttccttttagtcctacaatgtactgttcaatccaaaaagtctgaaccgcggctcgcaagctcgctgtgatgataaaaatttactatttctaaacactttagcctaacttgacaccacaagaccttaaattacatagcgaaacttttcaggaccttacatcttgagcccggactaagtggtaaatacaaccctttctgatcatcttccttgccttgagataggaaataaatctacctcttcgcgatgctgtattacctttccactccaaaacaggctcccatggaaattgaaatcagattatctttgatctacaatcaacgttggcatgacaagaagccaaccaatccatacccattataacatcaaattctaccatatctaactcgattaggtccgctacggtagatcgaccatgaactactattatacaatctctatatacttgcttagttatcactgagtccccaacaggtgtagacacctcataaggtttaaccaattaaggttttattccaaacttactagcaaccaacggagtaacacatgtaaggtagaacttgggccaatcagtgcatatacatcatatgtaatatacctgtaacaatatcaggcgatgactcctgatcctgtcgtcctgccaacgcataaatacggttctgaggaccactcgagctagatgctccgcctctgcctctaccgcgactcactggtggttgtgaaccttgcctaggagggcgtactaatggtgacgaaccagctacagatcctgctggctgagctatgcttgcatcacctctcgttggacaatcccttataatgtggctcggataaccacaagtatataaacaccacgtcaatacgacactgcccggcatgctgcttaccacactgagcacatcgtggcaagggcggcctcatctgacttgacatacccctacaatgagaacctgaggccctggaatgctgaccaggccctgaatatgtggaaagatcaaatctcttaccgccaaattgaggggtgcgctagccaatggttgggataaatacctcaagtattgttgcctctgaccacctcgaaactcaccagaaggactcgaagacctcgctttcttatcctgggccctatcatgctcacgatcctcttctctacttctgttatgctcctctacaccctgagtgtatgcctgaatacgagaaatatccatgcaactgaagtgagaccgacatacaatcgttaagcaagtgcggctctaatcccatgatgaaccagtgaacccgatcctccatattagatacaatagtgggagcatacctagccaacgaatcaaactgaagactatactcccgaacactcactggtcgacttctgtccgtctaagctctggtggcagataatgatgaaaaaaagcttctgtaaactcctgccatactgctggaggggcatcctcacctctggacaattcctaagactcgtaccaattaactgcaacatctcggagtctataggaagctagctcaactgactcagtcatagtggccttcattacccttaacgtcctctgcttctatcaataaatacctgaaggtcttcgtttggatctgccccagtgaataccggagggtctaaattaatgaagtcaagaaccctcgcactgaaagacctatctgcatgatcaatacctacttcttgatgccgagcatgtgcggctactaatcgggttaatagctgaatagcatctctcatctcctgaccggtgcatctggctgaggagctggacgtataggggtgggcgctggagctggtgccccttggagctcttctggaaagggcggggatgtgaagtctgagatggaatttcactatgagactctccctaaaccctggtaactcgtggcgctcgactagtagtctcgccaggcacggactttcccttcggggcgactgtagtctttggagcatcactgaaaatataacatatcattaggaacatgaattcttatatcgcacgatctaagataaaaagagaggataacatcctatttgtcctgtagttcctgtctataagtgtggtgcacgacacacccataaacaagactctactagacacggtctgtagacaaccctagtacagaactgctctgtcaccattttgtcacgacccaaaccaatgggccgcgacgagtgcccgagtcctacctgtcgaacactcttaagcatgcgactaagatataaacgtgaataatatttgctgaattatgagagtaaaaggcgcgaggaaaacctgtccaaaagacatatatacatatacgtgcgatttacagtggcgagccgacaagtccacgatagacaactatatacccaaaactgaaagccgacaagaccacatactatccaactgtactaactgtctacagacctctaatataaatacaactgtacaaagatgggactgagctacatcatatccatatatatacaagtatatcgtaccaagatcaaaaacagctccggaccaagtggagcacataaactcttgctgatcaaggatcctaagaagggggaccatcgacttgcctacctgcacctgcgggcatgaaatgcaggccctgaaaaataggacatcagtaagaataatgtactgagtatgtaaggcatgaaaatcagtacaaagagacataatgaaacatggaataaagaaatctatctataaatctgaataactttataaatcccgaaacatttataatgtcatgcactgcatataaatgtcgtgtcatgtataggtataggtgtacataatatcatcaagcctctgagggcatcctatcatatcgtctcgtccatgtgggcaacgtcatcaacatataccaactgatcggatggtggtgcgtataaacgccgtaccttttcctatatcccatataaatataatatacatatatacgcggatataacaccatcggtcataggtcaatgtacatgtataaatgcatgaaatgcataagaaatacgttaataaaattttttcggaacgccataaaaatcaatatgccttttggataaacattatcaaatacatatatttctgggacccatgaacaaaagataataataattcacatgtgaatcaagaatattgacatccctagtatttctatgaatagagtaatttatgaaaaccgtgtgtttgctcatttctcctatataatttggatcatgccaaaagaaagaagggatagccttaatatacctggagtagtaaaaatctgattgcaagaaatctcgttgctaatgtcttgtttctaacgttctgttggtgtctttgttttcaagaaatgaaaaaatgagcactgttgaaagctgaacatggctaacgtttccaggaatgttaagaaggctactattttgtaagattctaatgtcttttgaattgtaaagagttcctaatgttctaatataagaattgtataataatcacaagacatgtagtgtccctttcttgctacttaattccacctatcaaaatgaataagagtcattttccttaggttgtggccaactaccacgtttttggagggtggaatttattgattttatccatttattagttaattgggtatgtccctcacccgataattaatcaattacccgcataatttaaaaattatctcaaattacttaaaattctatttattttaatatacttcatatatcatataccatggtcatatggtaccttgtatggtactagtccataaatatgcggtattatcgctcaacccgtattttatcccaaatcggccaccttcaacgaaactcattttctttaattcgtgtaccctttatccttcatgacactttcttatcgcttgttataaatagcataaatacgttaacctcaagataatctcatccccaattctacgtcgattaactgcagactaaactttaatgtacgaaaatgcgatgtaacaaatcagaccatttgagatccttgatagagtgagagaggtgtcttatagacttgcgttgctctagggttatcctcagttcatctagtgttccatgtgtccatgctccggaagtatcaaggtgacccgtccctgtattagatttcagctctgtccagttggacaggatttgacttatgaggaggagccggtagccattctagatcgacaggttcgtcagttgaggccgaagagttattcttcagttcgagtgcagtggagacgtcagcctattgaggtagctacttgggagttcgtgtccgacatgcggagcagatacctccacttgttcgccaactcaggtacttttctatgtccgttcgaggacgaacgtttgttttagaggtggagaatgtgatgacccaaaggtcatcttacgttttagaacccaatctggtgttccgaggccttcaaaacctaattttatttcttctcgatttgcacagtctgggcgtgtttgcggaaagccccttatgtggaaaatttgagaaaaataataattttagcctttaaaatttattttagttgacaatggtcaatgttttgagtagacggacccggactcgtgttccgacggtcccggtgggtctgtaataaaatacgggacctgggcgtgtgcccgttatcgaattccgagctccctagctcgagcaatgaatttttgatgaaaattgtaagattgaaaatctatggaattaaagaaattgattaatgattgatgttgtttggtaccgggcctgtgttgataccaagtttttcaaaataattttttaaatgcatatatgtcttcaaaatcatgcattagcatcaattgtatttttccataattttttatatttttattaatttgcccagtattttatttctaataaataattacaaatttgcgtcacaaatgatttcaaaatatttcttgatctaatagtactatttacgggcttattaagtccaaattattctataagtggccaatttggcaccttttggctacaattacaaaactttgcaattatagcccatgcatataatttttgtgttatttttatcagaaaataatcttttgtattttaaatactaaataactattttttaaaagacatttccatgcatggaactcattttttataattagtaattattttacaaattattttggttaatttatttgggtatttaacaaatagccatttttttaattttcaattacaacctaaattagctagccaggcccaaacccgacctaacccgacccaatcttgttgaatcttggtcgttgatcattttgatcaacggtccagattccccattccttaattaacctaaattacccctcccaaaatccctcatttctctcttgactccgccgtcactcatctcccttctctatcgagttctgtctaatcccaaccctaattccccctcgccgtcactctaccgctgaccatggtggtttctcaccaccctcaggcccgtaatggctctctcacaccgggttttgctgtctctaaggtcctcaagggacaggggccagtccacttacgactttgacttttccttgcctgtttcaggccgttctgactcgatttccagtaggatcttcctatttttgcctaaatctatggatttctaagcctatgtctttgtatctgtgtgattcttttaaaaaaccctagtttcgtcctttggctttctcagatctgtacatatctgagattatttaaacttatttcatgtgtttcttaaaaaaagcttccggttattcaaagggtttttcattttcctaaactagggtttcttaaaaacctttcttcaaaacgtttactgatttttagtgtttaatctcctgttcttatgtgtgttcgactcattttgttaagtttttccttaaccctaactagttatgctaaaacccccattttttgacactttgtttaggattctgagtttgtccgttttatttgctacttggttttggttatgtgctttgattcgcatggcttctccttcgtctaatttgaatacttgatgattgtaccctagtatgtctctattagggtttcggattcgatctttttgtttatacttggcttatttgcttaatcactgaaacctatattattttccttaaacctagtattattttgagtccttgattcactgatttgctatggtatcacctatatactgatttccggttattttctatttttcataacctttaattgtttcttgctttatttctgactagttgtgatatgtgctaattcttattcactgttttcttaattaaactcttgtttatttatccctaattacctactccgtacataagtttatttgatttctttcttaaatactgttctactctttaccgttaactaattacccttaattagagggaaccttgcttattttgtgtatgattgaatctgtatatttctttaattgctacctaattgattctttaccttattttgtctagctctcaactactaatatactctcctctattctcactacacacacgaacattagttcacagaaaacactatcacacttctaaggctctctgttcttctcttttacttgcaatttgcattgaactagccagctataagccagtctagttatcatacaacttctgctctataccctgtgctttctctccttaactgttatgtcctaattcaatttcaagtccaaaactcaatgtgctctgttaatgctttagttcattgatttccagtcttgttcttgcttaccatcttgttgttcaatgtataactagcatgtctaaatcattgtttcacctagctttcctgaactacgctgttcaatcaatagcatgtataagttttgtcatgtttaacttgtatagggatttgcctattgctttatccagtatgcctcaacctgatttgttctatgtatgtcagcatgtttgattgtttgcctaatctgtttacttaggttctggtataacttactttgctaaaattgtctaatttctctaattaactctggttctatgcttagtttgtccagtaaatatgtttccacatggttgttctgtgatccatgccctatgtctttactaccagttgtatgattcttaatcttataaaactcttgaaaaggcttatgtgctcctatagctatatgtttcactatatgtgttctatatgttcccaattcccaatacccctgtgtaaattctgtcgatgctggacctgcttgttctgtagccaatcaggctgcttactgattttttcaaaaaatgtttacattgttttcaaactgttttactagctgattagtccttatttttagaaaacgtctttacttattgaatcaattatgtactgttttttcttgtcaaaacattttcaaaactatgtcaagcactctcactttactcttaagtccctaggttctgcccctccagtgtgtgtactgccttgggatccttatgagatttctatgaactctggcatactagggctgacccttccacactgcacttactcaatccctgttatgaaaagtctaggtgtgcgcactgcccgagatccttgaggtccttagggaactctgacacacctggacatgaacttggctatgaaatcctttggcatttgagatcattaaaggcccggacttaccaggtttgccttgggcctattgcaggctccctatagttaatttccttttcatttatgtaattcattcgatcattgatctataataattatttttaaacagatattggggtgactagtgataatgggagggtagttgtatgatactgttgataatactgggtaaaaagaatgctataggttttatatattctgtgaatttgcattagaatccatgtcttggactaatgtgttcatttgcatctaaatcatgctaacatgcattcgatatcttgttcttaaggcttcacatttattgcttcaacatatcatatatcactagtccgtgctttaatttcgcataagtactttcacttagaaatcctgctattaggttaacgaatagctttaacaaaaaaaattctggcactcttgtgttcatttagatatcatgttctaggaattccgcttgcattcgtttgaatacacctagtttaattaaaataagtcactgatcctggaaatgcataaaaatagtctcgcatataggtgtatgttttttctgagtataactggtaccaatcttttcattttcaaatccgcgtcacctagaacagcatatttgtaggttaaataacttcaaaactgttcaaaatatcttgtaattgttattacatacagtcccacgcctaggcaagccttaggtaatcaatctctataaaattggagactgcatttctgattgtttactgctaagttttacaggattaaaatcagtaggcatactattaggaccctgccaatgagttatgagacaagtgagtgtattaatgttcacctagacatcatgccctaagattctcctaaaaaaaatacctgtatttgtgttttgagacgtgctgttttattgctatatacttgtggagttaaacatgagccttctaactgtttctttcctttctacttgctggtcctacttgttatttgactgttgcctagatttcctttttaaataccttagggggttgtttagaactgaccagatttagaggtctacactcctcgggaccacaatgaagggacaggtaacaacacgcttagagttcgttaataaaactcgtttaataaacactaaggggtggggtaatgggtagaaaaggatatgatgaccagtgcactaatgcaacgtgtagcccctcatttgaggagtgattatcgggcattgcatagatatgatcctataggataaacaacttaggacccttttacctatttacatatgtgtgcttagactgctaatctgcaaaaacctttatttgtttacatatgtatgtttagactgcctattttcccttgattaattcgcaaagtaagtttggccaggacccacaattgtggactttgaggggtgcctaacaccttccacttgaagtcatttcaagcccttacccatctctggttattcaattggtgttataaatgacccgtagtaggtgccctaacgcgccttaattcgctaggtggcgactcttcaaattctttatatcccttttcccaaaaggaaatgagtttcccaataatgtcgaataccctatctaatccgaaaggagaggaaaagggggggggaggggggggggaggggggcgacaacctgtattttagttccggagcccggtacaggtttgatatatatttaagtcatgtatgtgaaatttagtgaaaacgaagtttattgacgtggttcggaccttgggttgagaaaatagaaaatttgaaactatcttgagaatttcattgattttgatgctaaatccgtagttttaggtgttattttggtgatttgatgcacggggagttcgtatgatatttttagacttgtgtgcatgtttggtttagagccctgaggctcgggtgagtttcggatatgttacgaagtgattttggaacttggaaatttgctggtgtaactgatatctatagcaggcctctaatcccgcagttgcgaaatcaggcatcgcaattgagaacctctcaggtcacacatttgcgaggccttcattgcatttgcaaaggaaggctggccagcgttctcgattttgcgaagttttcttcgcaattgcgaaggaaggcgagaaggggaaattatcgcaaatccgatcattttgtcgcatttgcggaggctcgtgttcgcaattgcgaacgttcccttcgcaattgcgaaggccacattagtgtgagggttttcgcatttgcgagattgcaaatgtgacactgcagcttataactttggactttgacgggatctttcattcattctcccatttttcaaaacctaaacttcaagaagcattttccaaaggctatttcttccccaaatcataggtaaatgattcttaactcatttctttcatcttttacatttttacaagatttcaacctagaatctaggattttcatggtgaaattagggattttgggtagaacttaggaatttcgaaatttaggaatttagacctcaaattgaggtcagattccaaaaccaattgtatatccgggatcgggggtgaatggtaatcggtgttggcctgaatttcgatttttaaccaagcgatcccggggtcggtttttgactttttgggaaaaatattgggaaacttataattatgcatttgaattggtttctttagcgataattgatgttattaagttgatattgactagatacgagtggttcggaggtggaatcgagaggtaaagcggtaattgagctttgaattgcccattggatagaggtaagtatttggtctaacttttactcgagggattagggatccccgacatgattgctatgtgaaatttcatgtacatggcgtataggtgtggcgacgagtacctatgcaccgccaaatttttgtttagcctgttcccttccccgttcccaacttattatcttcctgtcttaactgtttcatgctcattgatacttctatgtctaattgcttcttgttagatattggtttcttattgaaagtattagttgttctgtagtttcattgtgttacattattggtttaagctggtttgtcggtgtttcatggtatatttcggttagtctagttgtgtagtattaattggtgaagtttcataattgtatagatgttcgtttgtattggtttgaggcataaatattgtggaggattttgagctaaattgtgaaatacttgttcttgttgtgtgattggtactgatatgatgcgatcgggttgcacgtcgcaacaggagtaataagggtggacaggtgagatcgggttgcacgccgcaacaggaggaacgaggaagatatattcaagagttataagggtggacaagtgggatcgggttgcacgccgtaacaggagtaataagggtgaatgttcatgttgttactaattatatgttgggatcgggatgcacgccgcctcattttgttgtttatgtattctgcttctactgtgattttattatgtagcattgaaactctcttaaggattggttatagctgagtactggcaagataactgggttcggtgtttatttactgcaagttacggttccattttgtttcgtacttcctttttgctttattataaactgtatgcaggttatattgtaaatgccccgccgtagcctcgttgaagttaggctcgcacttaccagtacatggagttggttgtattgatactgcactctgcactttctgtgcagattttggagctgattgtggctgatcgagaggtcagttgcagacattcgtctaggagacccaaggtagtcctgcaagcgtctgcgggccctggcttcccctcctatgttctacatttctgttttattttctttcgaggaagatgtacttttctttcagaccaatacctgtagatactcatagaatgttcctcggttgtgacaccaatttctgggtgttaacagtttcgattttattaaaatataaggataaacagttagttatgtacttccgcttttatttccattgatttagttttgttaaattttaattacaaaagaaaaagtaaaggaaaaaggtgaatagaactctaacgttggcttgtttagcgagttcgatattaggtgccatcacggtcccgaatggtggaaaattcatgtcgtaacacaaacacaagtgttttttttcctggtataatttggttttacatacgtttatataactacaagctgattttataaaactattataaatgatttcaacgaaggcaaggtaccaaaaacataatatcaaataaatctgaaaatgagcattgagtaccactttttctttaaccaaaagagattacagtaggaggggatattaaccttattgcaataacattagaatttcaaaataaataacttataacagaaaagttgctcctccagagagagctacaactattttatttttgaattaaacaaaaatatatttttattaggaatacccaactttccctccttgataatgaagcaatctcactgaaaggttccaaagccaactctactttttatcaagtactttttgcacaatactgatcaaatttttcagcttttcatactgcaaaagaaaaaaccatataaaattaataatttatttatacatataaaacatttcaaaattggatatttgatgagatgaaaattatattaaagtcctcaagttccaattgggcaaaaggagcattttgtgttcgagcttaggtgccttgttttccaactttgtgctaagagtcctagaagacattacttagaaactagagcaaattaagataaactttttttttctttactttgttgtatgattttcttctcacaagtggagaaaaccctttaaatagattgttttcataatgttcttaccaaataaaattttggaagttcatattgttgtaataggatattaatgaattataaaaatttagaatatcttgagaaaatggtaagagattgattttgttatacaatttcatgagattaattgaaagtagcctaacaatgcttagatcgggactctagatcttgaaatataggtttttagatataaacttgaaacttgacaaattgtgggtgccaaatttgagtgcacatcaggatatcagtgtgatgatccaaagggtcatcttgtgttttaggactctattctgcgctcgttagcgttaaaaattttatgtttttacctactcgatttacgtgcgcagtccggacataattccgaaaatccttttatgtgaaaaattgtagaaataataatttttggcatttaaaagtgatttcagttgacttcagtcaacattttgagtaaacgaacccggactcgtgtttcgacggtcccagtaggtctgtagtaaaatatgggatttgggcgtatgctcagaatcgaatttcgagatccctagctcgagaaataaatttttgactaaaattgaattacagaaaattaatgattttgaagaatttgcttaatgcttgattttgatggtgtcagggctattttttggttccgggacccggtacagatccgttatgatatttgaaccttgtcactgaaatttagtgagaaacgaaacttatttgacgtgattcggacgttcggttgagaaaatgtaattttaaactgttcttgaaaaatttgtaggctttggtgctaaattcgtagttctaggtgttattttggcgatttgattgcacgagcaagtccgtatgattttttagacttttgtgcatatttggtttggagccctgagggctcgggtgagtttcgaaaaggcaacgggatgttttggacttggaaaatctggtgtaaatggttgtatatggtgtttgatccattattcttcacgatcgcgtagtcactctcatgatcacgaaggagaacttgattaataggcaattttctttttgcgaacacgaaggactggtcaccaacgcaaaggactggtccgaacgtggagcactggaggtgttacccttcacgaacgcgatggcttaggagacctggggagggtactaacgatacttttcgcaaacgcggaacttggctcgggaacgcataggctggggagagtaagccttcgcgaacgcgataggtatctctcgaacgcataggcctttgggccgctatgcatcgcgatcacgacaggtctctcgcgaacgcgatgaagacctgtccagtgttttaaaaaagaattcaaaatgggacttagtcccaaatttcatttttcatccttagaactcaacctagggcgatttttgaagagggatttcaacaccaaatcataggtttgcactttttaactcgatttttgtactcgtcacctcacatacacggcacccacacaacaaatgatatcaaacatcctaaggggaagtccccaatacagggttaggcaagccacttacctcaaacgctcaaatcaacttgaaatcacgttcttgctatgagtacccggctccaaatgacccaaatctattcaaattaattgcataatataaatataactttaagtaactaatttaactaatcaattcgaagctaaaacacgaaactagaaaaatcgccccaaaaagcctccccgggcccacatcttggaatagggtaaaaattataaatccgaacactcaatcactcatgagtctaaccataccaaatttactcaaatacgacaccaaattctcgatcaaaatcccaaatttggcctaggaacttttctcaatttttccccaatgtttcaccccaaatccgaaattaaatgataaaattatgtatagattagtgggaattaatcataaaggagttaggaatcattatccaaacatttcttcctaaaatctctccaaattttgcgttctaccaatctctcaatcaaattttgtgaatatgaactccaaccctcgtttttgaactttagattctgccgggtgatttccttaatagcgagcacagaaacaccctcgcgatcacgaagaacaacttcgctgcctcataattttactctatgcgaacgtgtaactccccacgcgaatgcgatgcaatagctcctcagacctacgcgatcgcgaagagcaacactcgactccactgctgcctcacttcttcttcgcgaaagcgacctagcccacacattcacgatgccccatttcaccactactacgtgttcgcatactcctgcccacgaacgcgaagaacaaacctcacaccccctagctaagcctacgcgatcgcggctcccttctcgcgatcgcgtataaggaaaccagatacaccagaaatctactatctttcaagtccaaagctagtccgttgagcatcctaaacacgcccgaggttcccgggacatcaatcaaacataccaactaatactaaaactccatacgaacttagtcgagctttcaaatcacatcaaacaatgttaaaaatcacgaatcaccctccaatccaaactttaagagcttgaaacttcaaaattctacaactgacgccgaaaccaaccaaactacgtccaatagaccccaaatttgacacacagatcacaaaagacactacgaacctacatccacttccgaaattccattccgagttcgatttcgaaatttcccctatcggccaaaatcaccaaaaatctaactttcgccaattcaagcctaaatctactacagacctctaaaacacatcccggacgctctcctaaccccaaaatcactcaacgaagctaattgagtcgacggaattccattccggacccgtcttcacatagttccaactaccatccaaattctaaggcttaaactcatatttagggactaagtgtcccaaaactctccgaattccataagtaatcactccaacaagtcccaatagcagaaacaagcttggagaaagcagttattaggggatcgagactctaactctcaaaacgactggccgggtcgttacaaagaccccattagcggcttgggacttggtgtgtatgactaaacatgaaggagggctgggaattacagacattataaaatggaatgaagctgtaattgctaaatatgtctggaatatttcacaaaaagctgataatctatgggtgaaatggataagttatgtgtacttaaaagataaagactgatggcagtacatatgccccactgattcttgctggtattggaagaaagtctgttgattgagaggtgtttgcccctggatttgctcagaatggttggaggactgttaatggacaatacacgatcaaggtggctatctatggagaatgggggaaaaggaagactgaccatggggaagatgggtgtggagcaagatgaatctacgaaagactgcagacaaaagtcaggttatgtcagataggcatcaaccaagatgataaatgccctatttgtggaacacatgcagagactatacaacatctattctttgaatgctcattctccaaacaacgcttacggagtgctatcttggatagtttcatacgactacagctgacagatatagcgcagggatatggaagagaatggctagaagtatcaaaggcaagaaatgctgggaagtgaccattgccatacttgctgctccgatatactggaaatgaaaggtcagaaatcaggctgtatgggatctcagcttcccacctcaacacatatgttgtgccaggttaaacaagaatgtagaatgaggaagacaacgtacttgaacagaaatatgagtgcaaagataaaagactggatcgaaaacctgctgcattgataaaatactggatagttagaattgctagagtttgatagatgtcataatggaaagtgtatagataaagtatatacagacgaagagatagataggaactaaaagaagaaaggagaaccgaagcatgtaattggccagtggtattaaattaataaaaaaatttcttcacaaaatatttatctgatcattatgatattggaactcggatgcctttccacaaaccctttagcttgggttttaatgcatgatagagaattatccctcgttgaaaaaggaaagaaaggaaaagtgtttaaaagcatttctttgtcttaaagagtttgaatattttaaaaaatattttggaggaaaattgagaatttagctatattattaatagttaagattgggcacttagacctattaagcaatttggaattaatattttagtcatctactattttattaattaatttaaaatgttttttgaattaaatttagaaaacgtatttaatagctttctttttaaattcaaacaggtgtctatgtgttttaaaaggtgtctgttataaaaagacgagtctattaattcaaacagactcttagagatattaaaatacccatatcatctccaaaacgaaattatctgaaaatttttatctctttctcttctacagcttattttctacaactcataaatattttgttctagtaggaaattcgagttaattgttgaaactcgaatttcagagattttgtaaaatcatggaggaattctgctattatccttacaacatcaaagtgattacactattggagccagattatttcatctcataattatttactaacaaaaactttgtacttttggatgtgataattgactattttgctgaaactaacggatcagaatattgtgtgttccaatttttattcgtcattcatctgtttagtagtaaaattattggtaaaaataaatatccttatttcaattgcattattaaagcttaagttccaaacacaagattttttttttttggtataatttggttttacatacgttatataactacaggccgatttcataaaaaatacaagaaatatatagcaaataaatctgcagtaacactagaatttcaagataaataagtaacttataatatagaaaagttgctcctctagagaagctacaattactttttctttagtttgctatgttttgcttgtcacaagatgctaaagtcctttaaatagattgttttcataatgttcttaccaaatataattgtggaagttcatattattgtaatataaattaatgaattctgaatatttagaatatcttgagaaaatggtaaggaattaatttcttattgaatataggtttcagaaaaaaaatttaaattcgacaattacttccaaatgggggtaaagaatagtgtgagtgccaaatttgagttcacaacaggatacctcttacaaagactctagtattccgttcggtaacgtaaggtcttgaacagcttcacattgtgtatatcgacatgcgtgcgtagttggattcagttacgataatccggagtcgaattggaaggaaaatttcaatttcggaagcttaatgatggaagttgaccggaagtttgacctttgtgtaaacggcctcgtaataagttttggttaatgtcaacagcttcgtatggtgaatttggacttaggcgcgtgtccggaattggttttggaggttcgtagagaatttgaggtaattcggcgaaagttagaattttgacgatttcggccgataagtgaaattttgatatcgggctcggaattgaattccaggagtggctgtaggtccgttgtcttattgtgacttgtctgcaaaatttggcattattccgggttgaattgatagatttcggcacgagttttgatatttgaagatttgaaaatttcataagtttgatttttggtattgattcgtcattttggtgttgtttatgtgatgtgagacctcgagcgagtccatgttaggttatatgacttgtttgtgtgattagacggggtcctggggtctcgggcgtgattcggacaggcttcgggtcaattctttcctatttttcactactgatatctgtaagctgaattcctctttccgttcgcgttcgcgatgagttattttagaggtactcgtgtttgcatcatagcccttcgcgttcgcgaagggtcttttctgggcagcccaatttttccttgtacgcgttcgcacaccctcttccgcattcgcataagcttttgccattttcgttccgcgttcgcgagcctgttcacgcgttcacgtagtcaattgagcagctctatttttttccttcttcgcgaacgtgctcctccctacgcgttcgcgattcattaaatacctgggtagaatataagttttccaaaatcgagggtttcaccatttttttatcatatttgacttctaaactcagattttggcaattttttatgggatttccacacaaatcgattgtgtaagtattcttcaaccagaattaaatatatttcatgaattagtccttgttttattatttaatttgtgttttgagttgagaaaaatgtgggttttgaaagaaaatttctaaattgaaaattcatgatttgagggaccaaatgatatcggaatttgataaattttgtatggttgaactcgtattggaatgggtaattggattttgtaaaattgttgggttccgaggtgcgggcccggggtcgacttttgggtcgatttttatacttttgtaaagattgaaactttattattcggaatagtttctcatacgctctatgtgtattttgaagttgttttagttgattttgagctgtccggaggtcttttgtcgagaagttcattttagagtaacgagttatcgtcttcgaggtaagtatcctacaaccttgtgtgggggaattaccccttaggatttgagtcttctatgttaattgtagccctgtacgcgaggtgatgagtgcgtacttggacttatttgcaaataggttggccttttagggttcttaggtccttatacgcctgtgtatagttctaactgctatgactgtattcttgattgctaatttcatcatttcctgcttaaattagaattacttgcttttagattttccttggttatttattaattgatttagctgaagattttacctcttctatcactatgttatattcttctttataaattgcctacttagctagaatttgtatcatctcgccctataattggtttagcaataattggaatatctttacattatgtcaagcatgcccgtgagtcgtatattgtgatttatatgattttccttaagtgctattaggtttagttaataattatccaagttgatggtattttcttgatgttgcctattactgagcattggtttaagctgggttttaaaattctgtgaaactaattatttaagcgagattggttatagctgtttcccttaccaggataatattgttttcattgttactcccttgcgagacagtatgatttctattattgttcatgttgttgatgatattgtttcattattgactcccttgccgggacaatatgatttctattattgttcatgttgttgatgatattattttcattgttgactcccttgccgagatagtatggtcttttgttgttatgatgttgattccttgccggaatgctatcatttcatttgtttgggtgagaaagagtgtaaagcacgaagagtgatgtcgtgccattgtttatattcattatcatgtgaggaaagagtgcaaagcacgaagggtgatgccgtgccattgtttatattcatttcatgtgaggaaagagtgtaaagcacgaagggtgatgtcgtgccattgtttatattcattatcatgtgaggaaagagtgtaaagcacgaagggtgatgccatgccattgttcatattcattatcatgtgaggaaagagtgtaagagaaaagtgatgcgtgccattgttatattcattatcatgtgaggaaagagtgtaaagcacgaagggtgatgccgtgccattgtttatattcattatcatgtgaggaaatagtgtaaagcacgaagggtgatgccgtgccattgtttatattcattatcatgtgaggaaagagtgtaaaggcacgaagggtgatgccgtgccattgtttatattcattatcttgtgaggaagagtgtaaagcatgaagggtgatgccgtgccattatttatattcattatcatgtaaggaaagagtgtaaagcacgaagggtgatgccgtgccattatttatattcattatcttgtgaggaagagtgcaaagcacgaagggtaatgtcgtgccatattattgtgaattcatggcacgaagggtgtttctgtgcaagtgaggacgagggacatgcattatgacgatatctgtttcctcgtgtatacattgtgcctttactttgagctgttattgttgtacttccatatttggtgtgacttattgttattgtcatgtacttgacatttatctcaattgtttctgccttgtccatgtcttttacttgcttaatttatgtgtcatatctgttgatttctatggggagtacgagagtaaaagtacgaagggtgatgtcgtgcacttgttctattggaaactaagttcgaaagacatctgttggaaaagtatatctttttaaaaaaaagctcttgatttaagggattatgtttaaagatttttctcctgcacagtatatatgtatgtatatatagatcggaggaagtaccttccaaagtaaaattttatatttgaaatgaatatattcaaagctttcaatataaacttataggtgaaggtttacactcgaagtattttttttaaaaaatacttagggttgttggctaaggcctgacgtggaaactgttgcaatgttgaattattactttgttcatgtcgtaatgtgattgtccagtttcggggtgttctctacattcctggtgtattattgtgacgttctattgttattggttatatttccttccgcatttttattagttatattgtgtagtcgtcagatagatattatatcctgtcatttcgatatttatgtatgttgatttattaaccagtgaatgtcctgactagtcctcgtcactacttcaccgagattagttttgatacttactgggcactgttgtggtgtgctcataatacacttttgtacatttattttgtgcagatccaggtattgattgttagtagtggcgcggatcatcgacgaggagactcaagataaacttgctgttgtgtttgtaggcttcagagtcaccttcctacttttattcaactgttcttacttatttctaaagcagttgtatttagaatttgtagcaagttctgtagagcttatgacttgtattaccggtttttgggaaattgtgaattctgtcaagatctctatatcgagactgtctttgttattgttgttattgagtaaatgttaggcttacctagtccctaagactaggtgccatcacgatacccaacagagggaaatttgggtcatgacaactcttccacttaatagaggcatacctagaatcccaagaaaatgggcataagactacaaagaggtgaatttagaatttatatttgacagatgccattcacttagaaattatagactaaaattaaatttttttttacaatgttcgtgattcttgacatttctacctatactatatacttacaatactgctgagattattaaactatgttacatcatccgctgctattaattttaattatataaatctatgcaatgccaaagggagatcaaggatttcttaggttagatttggagattttttatgaataaaaccaataagaaaaggaaaaaaagataaagatacttaactaaaaataagaggagacactagacatatcaacaaactaaaaattaaacccctaatcacttataaatgtgcatccaataatcattaaaccatatgactctttgagaaggggtgcgcggacacacacacacacacacacacacacacatatatatatatatatatataatatatatatatatatatatatattatatgagagagagagagcaagacggattaatgaaccggccggtcattttgagattattagccatgatcccctatttactgcttcccctgtatctttttctgcttatgtgacttgccgggaggctttgtttgtggtttcagagtgatttggaacagaagcttaagttctaggatattgatcgtagttagaactgtatgaagacggctccggaatgaggtttagtcagttcctttaactccattaggtgatttaagatttagaagcgtgtccggattgtgttttggaggtctgtagtaaaattaggctcaaaatggcaaaagttgaatttttgggaagtttgaccggaagtaaacttttttatattgggatcagatttcgattccggaagtttgagtaggtccataatgtcgaatatgacttatgtgaaaaaattgaggtcaaccggacgtggtttgataggttgcagtgtcggttgtagaagtttgaagttttaaagttcattaagtttgaattggagggtgattcgtgtttttaaaattgcttgatataatttaaaggcttgactgagttcgtatggtgttatatcacttgttggtatgtttggttgaagtccgggggagcttgggtggattctgggtggttaacggatcaatttggacttgttggaattgcagaaaaatctggtgtttcagttgctggtttacttcttcgcgttcgtgatgggagtgctgcgttcgcgaagcggagtcggaggcagatgaggattttttattctctttcgcaaagtaggagccacgttcacgaaggcttgggcagtggtgcatcgcgaacacatgaggggtatcgcgttcgcgtagaggaagtagggcagctgagatcccaaggcgtttgttctatccgttcaataggtgtcacattcgcgcagaagtttgtcaatcatgcatcgcattcgcgaaagggtctgcgtccgtatagaaggatttttggtcagtagctatttgtgccacacgaactcaagagagaggccgtgtttgcgacgaaggtatcaatgggccgaacataacatttcaaaatcgagggtttatccatttttgacataacttgagatagagagctcgaatttggacggaattttgagggattttcagatgcatcgattgggtaatgattcttcacttatttttggttatatcccactattctatcattaattccacccttaatttcggatttgggttgagaaaattagggaatatggaaaagttcttcaacaaaatttttgagttttgattgagattttatcgtcggatttgagtaattttggtacgagtgactcgcgggtgaatgtgtgtttgtattttgtgacttttacccaatttcgagacgtgggccccggtcgactctttgggacgattttcgaaagtcgtgttaaagtcttgatttcattaattagattaggctattatagttgtatttatagtatgtaattgtttttgcctagatttcggccattcggagtcggatattcgaggaaagggcattcttattgattgattgagcttggttcgaggtaagtagcttacctaaccttgtgtggggaaaattcccttaggatttggtactgtagtgatatttctgtaatatgtgagcgccatgtacgcgaagtgacgagtgcatatacgggctaattgctctaaaaatctggtgtttcactgagtagtagcctgttacaccttaattattttataccagcatgtgttgttatcatgtttagtctaatttcgcatatttgcgtgtcttaaatgcttatttgaaatttgtacagcatgtttagttgaattcctgacttgattctatcaaccttagctgtagaattcttgctgttaattgctttttccaccgatttgagttgtgtgttttcttttgggactacgaggcattacctcgggatcccctgcacatttacttttgggactacgagacagtagctcgggagcgttgttgttgtttatttccttgtgatgtgttgttatttctctgtgtattctttctattaaattctccgtcttcttccttttatatatcatttgtcttattattatatcccagtagggttcggacctgaccttgtcactactctaccgaggttaggcttggcacttactgtgtactgttgtggtgtactcatgctactcttctacacatgttttatatgcagatccaggtacttcttatcagctccgctattagctgagagtgtttgttgctgtacgaagacttcaaggtacatctaccgcatccgtagacctcaaagccccttctattccctcatttccgtactttcttagactctggtgtataaatatactagttttcttttgtaacttgtgacttatgattaccgggttttggaaactctgtgtgtactctagtactcggtagcttgtacatgtcgagcggcattttctcagtttatagttatctgttgtagcctagttgttaaattttgttttcatttatgttattctgcaatttgttaggcttacctagtcgtagagattagatatcgtcactacatcttacggagggagatttggatggtgacaatgggttcatgcaccccatgctccaacacatagatacccccagctgcataacatctgatacacacccaaacaaataaacacaaaataatatgtttcatatagcaaaagtatttttaatttgtctgattattctgaaatttgaaactctgatgtctgtccataagcatttttaactttgggtttaatgcataacggggaattttctacaaaccatgcctatcatgtcatgagtaatattaaaattactaataaaaatttcaagtggatgaatactcaacgcacatagcaaattatgttggactttaagagcattgggctttaaagattaagagtgtgaattgggaaatgatgggaaataaaatagagggaaatgaaaatttgaatcaagtgagctttgtcatgaactttgtaccatattggtgaaaaacaactacacttgtgtgtataaatataagatcacttcttagagctcttaaaaggagttgaagagaatgaaccctcgcgccgtcgtcgtcgctcggcttcggcttcggcttccgatcgataagattattttttggacaataattgcctataaaatctgaggcatggcttctatttcatttgctgaaaatcaacttctgaatactgcattcttcttcgcagtctctacctctctctcaaattcgtaagtgtgatttttctccgttctttgagttcattggtatcctgcagcttgtattgccactgttgcaggaaggtttattccgtttcatcctgggaggatttaatccattaccttggcaacttgtgagggggttaaaattacttaagaacgcacaaggaaattgtggtctcggaatatttcttttcgttttcagattttctgttttaacacagtgacgttttacaaattaaatatttttttggttatatttatcataagtagatttcgagcggttataagtgtgacttaatgatcaataaagtgaaagaaaatcataagctttcaagttccaatctcagtcgaggcaacagaataatgtttgatagcatagctaatgtctgcagtaatagtcgagagggatacattaacacaaattaagtaattacttcaaattactatttttctgtaaataatcatcattcagaaatgctctatagattgctcccaagtataatgactttacctaagttataataatattcctactttaaactgaaaaaaggacatatatttaaataaaatgtaattttttagaacgtaatattagatgaaatagaatgaaaatcatttattgatattgaagattagaacatgatttgaccactagaaaagtatttttcttatttatctatttaattaattatttacttatctactaatttgtttgtttatttattgtctttggttctttttctttttcctttttgggtttgcttttactctcttaaaattactcataaaaactctaaaatggtggattaattcttcatttctcttttttcttcacatttatggattctcccattgggtctagttttgatgaacaaatttagaagctagaagagtgagtttcttttgaataatttaaaagtctctctcttttttcttggtccatttgattttcggagtttttattcattcacgatattattcgttgttgttattttctttctggcttctctgatattactgtctctcctgttgagcggagagtctcccggaaacagcctttctacccttttcgggataggggaaaggtcaatgtacactctactctcctcagacctcactagcagcctttctatccttttcgggataggggtaaggtcaatgtacactgtactctcctcagacctcactagcgagatgttactggatatgttgttgttgttgtttagttataagcttgtcgatctttacctatctgtattcatctcatttttttccaacttgtttctccagttcaacaacgcacccttccccacatgggtctatttatggtggctatcatatctacgggttttaagatactatatgctttaaccttgtttcttcggttcaataatttcaacaacgcacccttccccacatgggtctatttaggtggctatcatatctacgggttttaaaatactatatgctttaaccttgtttctccggttcaacaatttcaacaacgcacccttccccacatgggtctatttatggtggctatcatatctacgggttttaagatactatatgctttaactcattttgttaaaatctttttttttatgatcctactttagattaattttctaattaatttatcttaaaacgtactaatctgatctacttgttttttatttttttacatctcgatctcattttcgttgtccgtcgaatagattcacatgtttcacttcattttttaaagaaagtaaaacagaaagttgatgcaattaagtaaatcaagaaggagaatgatttcttacctagttataaattttaatctatgctctaacaaatttttagtggcatttcaactgttttttgtatcctctaacaaatattcgaaacaaacgcttgttgttgggtttcaatattagcggacgcaaatttgccgcaaatccatttccaaatatgctatttagttacaaaattcgtctgtcgctaattcatttttttaagtgttaagtgattctattattactttaccaaaaaaaaaaaagaaattacaattaaagtgattataattaatttgagtttagaaacttttccttactaaaggtattattatccatggttaattaaacatttctagtgttgatgaagaatgttgaagagagttgggttgctacttacttttgaaattcacaaaaatataaaagatctcaaatttatttttcatgggataaagtcacgtaaataacataatattaatatccaaaaaattgataattaaatataggagattgccaaacatcataatgaatcaacgatttcttcttctcttatgatttatcaagttacaggggcctttctgccccaaggcaagcattccaaccaagccaagcagctatagatcttgagcgtcttgcaagggcatctgcgaagctgatttgaaaacaaaacattcgttccgtgacacttcctcctgtcagatagaagcttttcaaagggtgcttcgcttccagctcttcttgttcgatacagcttcccgtccttgtaaatatcgttcggtaagttaaggtccatgcttgaaacgaaaaaaaaagaggaagaggaaggggtcgcccaaagctgtggagataaggtggaagataaaaaagctctttgattgataaatagaactagatctcgacctggcctcaacctatcgattgagtgagttggagaagaaagcagttctccgtgcaccggacacgtagcttgacccaacgagagttactatgatcaactaaattaaatagtaaacgatttgtttttcagtggataagtgtatattgatcgaccaaattaagtttgtctgaaattactaaaccccaataattggtcaaagaatgtaccaaaaaattagaaatttgctcaatgaattatagagcatgcattgtatagctatttataatgagagttataaataatgagataagtacatcatttattctaagataagaatgagattgtagatatacatgaaatgcgtacacgattagtgatgagattatgagataaatatactatgctaagagtcctaatacctgcattaataagaaacaatttaggggaaaaataaaaaatagcaagatatataactagtaactgaaaaatagccatagtttgaaaaataattaaaatttagcaattttttctgtaaagataaaatctaaaaaatatatacttaaaaatccggaaatattccagcataatatgttggaattcgaaatttttatatgatatgctggaagtttatacgcatgagctccataatctcacatattatactggaatttttcgtgtttcaataaaatagtgactatttttcaatgactttacaaactccgataattttttaattatgaggccgaaaactggctagcccgtgctattttcacaacaatttacttcatgcataaaatgccaacttcacctatataagcatgtacgagaatgaaaatggtgtggcaaaccgttgaacttttttgccatttaaacttggacaatgtgtaatatagtccgagctagtggcaacgaagcgtagaagataaaagaaaattaaaataatgatctaattgggttggataatcagtttagtgggttggcccggagctatttgcagtcgtatcttatatttgtatagaaataatgtgggatactaactttttaacgtagtatttagtttttatccagtgtttttaatgctgagtaaaaatagccacaactctattaaaattaaatgaagatgtttttaccctttcttcataagtgctgtgtaaattaaatattaaggacatggtgtccttaatatttacactacacacatgaagttaaggacgtcatgtccttaacatttgcactgttcatatgaagttaaggacatgaagtcctaaagtttaacaaaggaatgtaaaaataaaagatattttgtcattaatatttacaaagcattcatgaagttaaggacattatgtccttaatatttaccaacactcataaagttaagggcattatgtccttagcatttacattgctcacatgaagttaaagacacgtgtacttaacatttacattgtacatatgaagttaaggacatgaggtcctaaagtttaacaacagaaggtacaaatacaagttaaggacataatgtccttaacatttacactgcacacatgaagttaaggacgccatgtccttagcatttacactgtacatatgaagctatggaaatgatgtcctaaagtttaataacggaaagtgcaaataccagacacttcgtccttaatatttacacaatattcatgaagttaaggatcatgtccttaatatttgcacatcattcatgaagttaagaacactatgtccttaatatttacacaacattcatgaattaaggacaccatgtccttaatatttacacagcattcatgaagttaaggacaccatgtcctaaatttacacagcattcatgaagttaaggacaccatgtccttaatatttacacaacacccatgtctaacacaggggtattttcgtccaggcgggtaaaagattattaagcactggctaaaaagtaaatacattttaaacagcagctaaagagtaaagacatctctaaatagtggataaccgtgcactttcccctatatttgtgccacattttaacatataccctatttttaaaaataattaatttggtacccgattaacaaaacatccggaataatatgaccattatatccctgacaaaacatataaaagatgcatcacgcatattacggttctcctccatcactccgtccctcctcacatcttctctcgcatctgccataatcacgaaaccaaaaaattgaacctgatccaaatttcaaattcaaatcatcttcagaattcaaattacaaaatacatttattgcaaatcatcttcagaattcaaattagtttttgaaattgattgatcttcatgaattcatcattttttttttgagttttaattcaatcaactcatatattttaatcacagttgcatgaagttgtttgactgataaaatatgctgaagttttgttctggattcaatagttttgtcatgagcttttcaaaacttcaacagaagatacttaagttttttagttcatttgcaaatacttcagcactaaaatatgctgaagttttgtcctggatttaatagttttgtcgtgagatttttcaaaaacttcagtaaaagatgttaaacttttctagttcatttgctaatacgtcagcactaaaatatgctgaaattttgtcctggattcaataattctgtcataaactttttcaaaaacttcagcaaaagatgctgaagttgtttagttcatttgtgaaaacttctggacaaagctgctgaagtttttcacaccaaaacgctgaagtctttgtcttgcaatataaacaaactgaagttttttagttcatttgctaatacttcagcactaaaatatgctgaagttttttcccggattcaataattttgtcatgagatttttctgaaactttagcagaagatgctgaagttgtttagttcatttgtaaaaacttcaggacaaacctgctgaagttttcctcctgcactatgtaattttctcctgcatgctggagttaaatttagttcatgcttaagttttgtcctacattaaacagctttttcatgagctttttttcgaaaacttcagtataaacaagctgaagtgttctagtacatttggtaaaattttagcttcaacatgcttacgtttttctcctgcagtatgtatatttctagtgaattttttatgaacttcataaataacttcttttgatcaattcctaatacttgacactaaacatacttttgcaggatgagttcgatttaaaagacgcgaccaaatagggaaaaatcgtctttttaaaaagcatttaataaaaaaatgagtacggatgcaaacaaaaaataaagtgaatacaaattaaaaaggaacgaccaaatacgacgcccatgcaatttttacgttggcccgagctaataatttaaggactgaatcgtgttattaaatttttggatgaatcaatagggttgggttgtgatccatcccacttgacacgtttattttagcgaagtgcacatatagccgattttaggacctattttttagacatagccgaagtttattaatttagctactttaaattcaaacttacgagtcgtgtccaaacatcctcggctatttttgtggacaggtcaggttaccatatccaggagggccctagtcacatgggagaaggtctgtttacttagaggcagtggcgaagttagggattttcccaagggtgttcaaatataaaagcaatgaaaatcaggtgttatgcctgaagctagtaaagcaaatcttgaacgatgataaatcagacaataaaagagaaagctactaaaagaaacataaacatttaacgtggttcggcaagttgacctatgtctacggcggagatgagcaattcactatatataaagagagtacaaaatatcgagagaacaacctcacgaagaggcaaacacaagtgacacactacacttgtcccgtaaagttctccccataaacacgactctcaaatctcttatgactacattgtggatgctgctgaacgagaaggaaggatctttaatttataaaagtccaaactttttcctacatgaaaagggactattcaaataaggaagatttataatttccttctacaagaaggaaatccaatcaagctaaatatgttcgtccattccttcaagagataggaaaactaaatatgataagaaaatcaggacaacacctaacaatcagagtgtcaatgggttcaacagaaaccaagaaggagggcccctcaaggaactttatttaaagcttgctttgttgatgtagtgtatgacatttggatcgaaaagaatacttgagtgtatcaaaatagagctacaaacatggaaacaatgatgcatgatctgaaaacctctatatacattagagttaggggtaacaaaaaattatttatctgttttttgtaggagttttaatgttttagtagataatgttgttggttccataagataggcaggggcaaagctacagtagtaagtgcgagtttgggcgaattcagtgactttgggttcggtggtcaaggttctgggttcgaagcaaaaggatacagatcgaagaaaccacaaacttaattaagacatacaaggcttcaaagaacaaatcgaagaaacccatcaaattggggagtagttcaaagttggagttttacaaatattttaaataaaaaaacaaaaaaattagctataataagaaaatgaaaatatatataataagaaagaaaaaaaaaactacccattcaaattggggaatagttttaagtttgagttttacaaatatttaaaatatatatataattcgctataatagaaaaataaaaatatataataaaaattatctattcaaattcgggagtagcttcaagctggagctttaaatttatttttgaataaaaaataaaataaaaaaataaagaaactttcacttcaaatggaaaatacaaaattaatctctttatacttttgataaattcaaaattataatttagtaaataatattaatttatttaaatttttaataaactacaaaatttaaaagctaatcaaataagtattatacagtagaaaggcatgtacaaagagaaggggataaagataattttatgatatttatattttaattaattaaagaataaaagataaataaataacactcaaaaaaatttatcaatagtactaattacttgctaattcaataattaaaatgggacttagtaacaaaaagttccattaggacttagtgccttgttttatttgtaagaaattaaaacataaatcaaattgaacaaaaaaatgctcttctaaataaaaaaaatgagaagttttccgattaaacttttgggtttgatcgattattgacctcttttgttattttttttaataaagtaattagtcgagtgcaattgaaataaagtaattgatactttttaaatatatattaaatttcgatactcgttctttaatcggcttgttattgtatattagttttaggtcataattctatcttaaatttaagatccatacactttaaatcgtaactccacctctgctggtaagttgcctttattttgaactggtgtaataatattattttgattgcccaaaaaaaaaatgaagtttagcttgcctaaagcttggagcagggatgtttgtgtgctaagaagtgaattaaggctttactttagtctctaggttcgcgcccgcttcttcaagtccgccctttctttcagaaaaaataacgagcagaaaatggatgcactaaggcgtaacgactttaaggacattcaagattttttggagaggcacgactccctagagaagtaggaggtccattgaaaatgtaaagaacgcaatcaataacggaggcaggatttttattaagaacgatattaaacatttatcactactagaaattcgatgattagcgaccagaaaaatcgaccaacgttgattggttatgtcaaattaccttccaaagggtcgggttctgttagggattgatagacttgtgaagatcctaattagtatatataatttatcatcaaatatatatgtgtgtaaattaattcatcgacttataacttacttagatgcatcgttgaatattaaaaaaacatctatatatatatatatatatatatatatatatatatatatatatataacacgcttcattgtactactttaattcatatatagcatgttatagtatatgttatcccttatattacaaaagtattaacggattacatttatattatttagatagtaaatataaaagtgatttgaccaatgttaaccgaccaactttggtcggttattatccagaaattaaagtatactgaccaaagttggtcggtaaatacttcccctgtattaaccgaccaactttggtcggtaattttaaataaaatttctttatattttataaaatattttaaataataatataactataaaaaaattaaaattgggtcccacattaccgaccaaacaagtctgaccagctcagtcaacttgttgaccattttaccgaccaactttggtcggtattttatttaaaataaatataaaatatttttctcccattttctgatcaactttggtcgctttttttgaccgatcaattttatttgaaaattttagtcgctaattactaaatttctagtagtgtattgtatatatataaaaaaaaaaagttaaccttgcatgtaaaatgtgatttgctggagttcgaatgaatctccttccgcccctggatgcaactgccaacatttaatttgagcaaccatgagctcttaatagaaaagattggaatgaactaaattttcaagaaaatgcaccaaaaataaccaaaaaaaaaagagaagataagtctcaaaattagtctatcaatattaaaaaacagcaataacatctcaatcttgagatttcacaagtcacattgaaaggaaaataccatccttcaaatttatttttgtctaagttttaaaatctcttagaaaataaaaataaataaataaaaaaaaacagcatgaaattaaaccatcatcatttttttttaatcagcgcagtccaatgcaactttgatcttttgaactgtagagctcaaaagtgtatgcacattagccactgcctccatattttcctgcttggaaattaaattattattattattattattattggcagaaaccaatatttgaaaagccacagtcaacagcgaaccggtttgtgaaattccattactgtccctatccgcggcaagacgaccatcaggacttatgatgaaaccagagggcaatatgggaatttgggtggtgtctgctccattgataattgaagtaactgttggtaaatctattggtgcatagattataaaggctcccattggatcaatattggtttcttgaagcaataacatgttgttctcctttggcacataaggctgcaaatataacaatgacgagtttaacttttatacactaataaatatatataataatttttttttacactatcgaatcaaataaaagataattatgaataacggataaatttaataaatggtcatataattatgatatttttttcataaaagttctgtaaatttattttctcatacaaaaatcattaaactttcactaactcacataaaaatcataatgaccgaaaaacacagttttccggtagtattttcttattcctcattttttttttttttatttcagtcttaataaataataatccaaataaaaaaggacaaacatttatttttagtcgctccaaaaaataataacagataatatatgtatttttatgtatgtgtgtattaaatacatataatatacatattctatatattttttgtctaacgaatgaaattagttttggtcaaccagtcatttttgtaatttttaaaaaaaaagaatgatccaatccaacccaaaagtactacttggaaaatgcagataacatgatgtaacaaattaaattatattgatgtagtataaaataagtgactaaagtaaaattggctacagaaatgcctttttaaagcctaaaaaaaatatatatacgagttaaatataataattttaagagaaaatttaatagttaaggtgcatacctgaattattgaaatacaatttccaggaaaaaatcctgttggtatttgggctaactcacccacagcattcccattggttaaaacatcccactgcaccaacaaaatcaaactttaattaataaaatctgcattaatttgtataaataaattgaagtcatgtatgacgagagtgatatcaagcaagcaaaagcataattaactgataagaaaatgggctttgaacctaatttaatcgtgaaaattgacgtatgaagtgacgattgtccaatattataataataagaaaatgagatatttgtaccatatataaatattgttaaatggcactctttaaattatatcctcattagttgggtggactaaatttcgctattaagtaggcgtttggacataagaattgtaaaattctaaaaaatggtgaaaaaaaattttcaagtgaaaatgatatttgaaatttagaattgtgtttggacataaatttcaatttgggttgtttctgaagtcttgtgagtgatttgagtgaaaattttggaaaacagttttttcgagtttttcaaattttctaaaatgcatcttcaactgaaaattggaaattttatgaacaaacgctgatttcgaaaaaaataatttttttttttttttgaaaaaaaaggaaaaaagaaatatatgtccaaacgggctctaaaagttgttggggttcctcctttttttaagacaaatttacttcattggactatcaaaggatataatataaagaattgccacaaaaaaggctgtttgtgcaaatatcccaaggggtaagtgcatagatagccattctcgttatttaaagattagccagtacttattttgtcatgtaattttaactttaggacaattcagaataattttgtccccaaaatttgaagtaaaaaatagaagttcgagacgcactgattaatgtctaaataacagctttttagagtgactacctactgttatttctactaaaatagacctttgacgtaactcaatctttaaatattaaaaagaatattaaaggaaagatacaaacctgaggtcttgtcttgtcatctttgaagaaattaaaaacagtatcaaatgaaagaggaagccatagggaagtagcagcagtaacaatcaagccttttggttgacttatatcttcattttttctaaatgaaactcgaactccactatttgtcatctctgatgaagtagggaaatctaatctatctcccatacttagtatttcacaaaaactcttcaccatcctttgagatatttgcatgacattttgctttccttctagtgcaccaatcactaaaagaaagaaaaataaaatgacataataaaaaaaatgtatttagacacttaaaccaatgtccggcctgcagtggcgtatgcaggatttttggtaagtggtgttactgtttgaagaaataaacggaggaataaaaggacagttgatgcattacgctcccgctcgtgtttgggaagggccggaccacaagggtctattgtacgcagccttaccttgcatttctgcaagaggctgtttccacggctcgaatccgtgacccctggtctcatggcagcaactttaccagttacgccaacactctgatccccttcaaatgaacgaataaataaatcactataataacaagcattgtcattttttatagggatccttatacaaatagccgaccatattcattgttcactttttctaaccacatacaaagattatacattgattatatataattatacatatattatacttccactgattatttttagtttaagagatcggacacggctatttgggttgattcttctttcttttcttttttttttttaatatttactcccaatattttcatttagtatacaacttatatatacgtattttataaaaatttcgacgaagcgatgtcatatgacactgcttgtcgaggtgtatctgcccctatatgtcagacgactgaggcggaatcaggatttgaagttcataggttcgagaacccgtattctgcattctagctcctccatgatcgggtggtagacaggcaacaacataaggtgttaatagacctgcgtcggaccctaagtttaggtgtcttgaataaaagttgtgacagattaaagggcaacctgatgtattaggcatcccgcattcatgcaggattcggataagagttgcaccccaaaggtctgatgtagacaacctactctaatgctatcctaatacaaaaatttatgactgcttccacgactcgaactcgtgagaagaaaaaaaaggaaaaggaatggatttacctccttctaaatcatgattgtttgcacccattgcaaaattgtgtctctcagacatcctttgaagactaattatccatctcttagctccaaatgtttgacgaccacacactaaatctctatagagacgattagtatgagttttgtcatccacatgaacatgctcaagccaagtaacctacaagagaaaaattaaaatttaagaatcttaatcatagccaaaagaggatattaaaaggggaaaagacaaaactataagctaaattatattagacataaagggtaattggtaatgttagagacaaaaattttaataaagagattcaaaaaagatcaagaatgttatggatatgacttaaaccttcaatcaaaaagcaatatgggaactaattaacaatttatatatatactgaaaatttatttttacctttattgcgcaatataattttcttacaaagaggattcaattgaactccctttcggatcctatagctccccttctgctaatggcatgatgttcaacttatagaaaataatatcgaaatactactgcagtcaaacctttctataacagtttcgagctcgttcgttctgatattttttaaaatgctatagtgaattattgtttgttatccctttattcttagattgttattattatcgttgattgctaccttggattcggtcctcctttatcttcttgttgtttatacttgttttctttacttcttttatcttttctttagccgaggatcttccagatacaatttttctgccttctagggtaagggcaagattgcgtacatctcaccctccccataccccactggtgaaaattcactggatttttgtgttgatgttgttgtagtaaactgaagtgttgtcatagaagacatatatcataacataatataaaaactggttagaaaacaaacttaacttttatagtaaatcactgttatatatgaatcttgttatagaaagttctgtacctctaagacttatagtttggtggtataaatcaattctcactatcccgaagctagctctttggatacgggttcgaccgaacacagtataacttttgtccaaacttcttacttgtcttaaaaaattattaaattatgcataaattattaacttaaaactcgacaacttagaaaaattaaaatcctgaactcataaaattcaaatcccgatttcgcctctttttttaacataacataacttatgggaagtaggctaacaataaacagtaatagaggaaatcatagacaatattcttaccatacttttcccattgcccaaatcttgaataacacaaccagaaggaaacttccatgtctgagaaggtccaccactttgaatttctcttaagttatcatatgaaacatcaaccattgtccatgttgttggatcaagttgtcgacaacaacgaatgaagaaaaaatctcttgctcccacaagaggagatagaatatgtaacttttcatacatctgttccaaagaaaaaaattattaaaaagttggtatatcattttaatctatgtcgctcggactctctaataatgttgcctgaaatcgtgtcggatcctccaaaagtagtgaatttatttagggtccgatacaggtacaacatcatttgagcgagttcgcgcaacgtagtttttaatgcaccacggttggtatatcattttaatctgtattgctggattctgaaaatgccgccaggtctgtgtcgaatcctccaaaagtggtgaactttttgagggtccgacataggtacaacatcgttttggagagttcgtgcaatatagtttttaatgtaccgcggttggtatatcattttaatctatattgctcggactctctgaaaatgtcgcccggtccgtgttggatccttcaaaagtaataatttttttagggtccgacataggtacgacatcattttgaagagttcgcgcaacatagtttttaatgcaccacggttggtatatcattttaatctatattgctcggactctctgaaaatgacgtcgtgtctatgtcgggtcctccaaaagtagtaaaatttttaagaatccgacacaaatgcgctcctacgctattttagagagttcgcacaacatagtttttaatgcaccacgattttgatgtttatttttctaggagataataaaaaatggattaaagtttttataccaattgtacagaacctccgaaattctcagtatcaacaacttcaattgtcctagcttttgtgacaatagtaggaaacatgttcatatatctgacctgcatatacaaattaaatcatcatttttttaagtatatatgaaattaaacaatatacagaatagaattttaataaaaataaataaacaagcactagatactagcatacatctctaaccaaactaaaactatttttttttcttttaattgtactggattttcattatttgaaaagaaaaaaaaaaggcaacccagtgcactaagttcccgttgtgtgtgcggttcggggaagagccggaccatggagatctatttgtacgcagccctaacttgcatttctgcaagagactatttccacagctcaaacccgtaaccttctggtcacatggcagcaactttacgagtacccgatttttcattatggtttttaaaaattcaaaagaaattatgattatctaattaaatttcaaatatttttattctaaactttaataaaaaaaatattatccaaaaagcatacttactggatcaagaaatatttgaatcagctcaattgcagtcattgtcacaactccagattcctttgatgattcaatacgagcagcagatgatttataaggttgatttggctttggataaatcttttcataactatcacgataaataaaatatctcccatcaatttgtgacttaatccaaattggttcattcatttgcaaaagctccacaatttcatctgttgcactaataacactcccaaatattaatgatttttctcggtcaacacgaatttcttcgttttcttgaattattgatggtggtggtggtggtgatggtaacggccgcggtggaatattagctgttgaatttcctcgaacattatttagttgattttcaatgggagaaccaactatattttggctaaccaaactttcatcagatgaacttgataatgatccaacagtattttgtggtgctaattgtgaagtcattgcaaatgaccttccccaaaactggagattaaattagatattctttcatgctgcaataattaaaataaaaattttaaataagtccgtgaaaaggctgagaaataaaatacgaaaaaaatttaacaataagtgtgaaattataccatgaaatgttaatgaaaccaagcaaactaaaagtgtgagatcataaaatagtgataagatgaggatatatataaacttcaattgccaactttttcttttttttaaaaaaaaaataataaattaacggtattgtttagatcagtttgtgcgcacctggatcaaatattttaatataatcaagtaaaaataaagtaaataacctactataaaaaggttaagttattatgcaaaaatagcgtaaactattttcgttcagttcattgattgcgactaggacgatcttctctcgtcagaggcatatgcaattcataagtatcgggttcatccaaactcaatatttttaagatagaatataaaaatatatgtaaaacccgattaaattcctacaaatactagatcgaactcataataatttcatatatacaatagttgtatgcaaaaaaaacgtaaagatcaaatccatcaagtttaaaacataaatctgcttctatctttgatatatatatttgtaagtaatttcttttattccttaattttactgagattaatgaaaaggtaaattcgaaacttttctatataatacacaataatccttacatgtagtctagtactcatgaaagatcttttttgtagtcaaataaaattcaactaaaaattgtcaaaaaaaaagtttaattaaataacagcaaacaacaacagtaacgacctagtaaaatcttacaagtggagtctggggagggtaatgtgtacgtagaccttactccaaccgcgatggagtagagagactgtttacgaaagactctcaattcaaaaatacggaaaagacgagaagagaagaggcaatatatcagttttaattaaatacaaataataaataaataatttacctcatctctcaatcgttgatttgccattttcattttttccaaattacgttttctttcttcttctccaggggtggtggaccatcacagtgtgggcaaataatatttttcagtgcctctctcattgccatattctcacaatgaaatctttcattttctgttcgaagatattgttgtctgctctctcacttagtgcctgtaatttatttatatacaaataatcacataaatatatagatacataaatcagattattagctaattaaatttagtaagaaaatgaaattagtatttcctggaaagaatatttttaaatgtgtgaaaatatctgtttttaattaaattctctttgctatatattgttatacaaataacctgtcagatttaatatttattttttctagcaggtatacatagattacacgtagttatgcatatattatacatgaattgtatatatattatacatctgccggctatttataatttaatagattaggtgagcggctacttgggttaattcttccttttattttcaattgtgcaaatagatttcttgagttttaattgttttaaatgaattactgatactagcaatttttattctattctttttctcattctttcataacattataattaacttatatgcctaaataaagtaaaaaaaaagaaaggaaataagcatttaaaaagttcaattgaaaatagaagaaggaaaatgtctatttatctaatttaagttggaagggaagttcaaaattttagataaaataggagcgagaaaaaaaaaatcaacgtatgagtggcaaaattagtgggcaattttaaaaatcggtctgccgaaagtaattgtatttgctagtcagaaagtttataaaatatatatattttatgaatataataaatatatacaaaaatatatatttatcggtaattatttttggagaaggctaaaaagttaaatatatacatttctcaaaatttgtcatgataggctgggcatatcatggcgggccaattaggacagatatcaagtcagctgggctgatttggattaaatatgtagcccaaattaacttattagaaaaattggtaaaaattgtgcggggccgccttatttggtcgccctcatttaacatatactcatatttttaaaattatttaacctataccttaatttttacaacttcaggcgccgccttcctgatacctgtgcaaaacttcagcatatttagcgcttaatttttacaaaatgaactaaataacttcagtatcttctactgaagtttttgaaaagctttattgcaaaactaatgaatccaggacaaaacttcagcttatctagtgctgaagtttttacaaatgattaatagcttcagcttcttttgctgaagttttgaaaacgaactaaataacttcagcactgaagttttttacaaaagatttatgacaacactaattaattcaggacaaaacttcagcttatttagtgctgaagtttttacaaatgaactaaataacttctgcatcttctgctgaagttattgaaaaggctttatgacaaaactaattaatccaggacaaaatttcagcttatttagtgctgaagtttttacaaatgaactaaataacttcagcacttctgctgaagtttttgaaaaacctagaatgctgaagttttatgtgattgcctttgctacttcaagcccgtaagcctgaagtttatgcgaaaagtgggtacgcttgtattttttttttgcaaagcgggtataagttaaaacgtgacccaaaaagcgggtatagatgcaaaagcccaaaaaattaaagaattaatccaaataaccgctcactcaactgcttaaactaggaatagccggtgggagtatattaaatgcgtaatgtatatattatatatgtataatcgtatataatcaatgtgtaacatatgtatatggctagaaaaaataaacagtgaatatgtccggctatttgtataaagatcccaaaaaaaaaaattgtccgcgcaatatttttttaaattttttggtatgatatgttaaaatatagtcacaataaaaaaaaaattattaggaagtttccctaattaaaacaattattagaaaataaataaaacaatttaaagttgggagaaattcaaaatagccagatttacaagtggtcattcaaaaatagccacactctcaaaagtaatcgaaatttagccacttttcatgtaaagataaatctgaatgaaaacgttattcaaaatccgtaaaatactccagtatattatactggagttccagcataagtatactggaactcctgcataatataatggacttccagcataagtatactcgaattccagcataatatactggagttccaacaaagtatatcggtccagtataatatgctggaaattcatacatatctgctcgctccagtatattatgctggaactttctgcgtgttggagttccagcataatatgctggaagttcatacacaggtgcaccgaactccagtatattatgctgggccagtctctattacagtaaaatagtgactatttttcaataacttgacaaacactgctattttcgaataaccagtccggaaattgactagcacgtgctatttttactttaaaacttagagtttatcaaattgggctataattctttttagccctctaaatttctgtaattcgtcaatgattccaaaaaggaataatcattagtcactagctgtaacaccagattttttgtggcttcaactggaaattatgtaacttcccaaaaatctaccaaaaatagaaaaataattctatttaattagattcctcgctaagatatagaaagtatttcagattatttgacctgattctattatagtactttttaatcaagggcgctgaatagtttgcggcctaaagttaaactttaataataagccttaaatttattttaagggacccatgcattttgggacgaacgcaagaactttaatggcctcaccctagagccggccttacttataattaatcaatttttaattgtaatccatatatatatcttataacaaagttgctttttattagattttcacatacttcaattaatttactatcgatgatcaatactcaaaggtgtcagttaattataattaattatttaaaaattaaatcagtcatgcatataaaaaatagactaaattaaatcacctttgtttgtgtccttttgttttgaaaccaaaacttgatttgcttaggatcaagccctatttccctactcatttgcgtcgctggttctcatctggatgtggacattccttgaaatatcttcatttcattattaaaaaaaaaaaaaaaaccaacatcagtattcagtggcgaagtcaaaaaaatttcttaaaactatacaagacttaatatacatgaataaagtaatttttgacctatatatatatatatatggtataatttttcaactaagttcaactaaccaagtatttgccaactttttttcaataaacctaaaaaagaaaaaagaaaaaataatattgtataaccgctctcaaaataatagtcgaaattatatatttttatatatatatatatatatatatatatttattttatatacttttttggttatcgaatataaatagtttatgatgcatgctaaaagtgaaaaaacccgttagcatgagttttttctcatgtaacgagaagagattaaaagaaaatcgcacccttatgtaaaagttaatgtataaaccaagaacaacaaattcatgtataaaaaaaagatttatatggtaaatcatcatccaaataaactctttttgatccattttagcaagtaaatcaaaaaattaaatacaaaaattaattatattaatcctttactaaattttaatgggcttataaggaacaaaggaccaaaaaaagacatgaaatgaataagaaatattaatgcacaaaaaaaaaacacatatagaaaaagaaagtatttcatggttaattaattttatttttaacactcatttctatcttagaaaatgactacatttccttataccaatttgtttttttttttactaataaaaagtaaataataaaaaatttggccatatatgaagatgcaatttttattttttttattttaaatctttcaaataaaatcttacgtttcaagctgctgaatttgttccacagaatgtctgttacacagcttctgcctccttgatctttttctagagcttgaggattctccaatttgttcattcccagaatcagccattttcctttgcttttctattcaaaataaaaataataaattttaaaaaaagtgtttctttgatttaattcttaacaaaatctacttatatataaaataataataattgaacaaaaagaaaagagataaaagagatttctacatacctatgatatgttaaaaggattgagaataaaagagagaatattatataatatggtctttttttatagtagaaaacaaattgactacacatgaatagacatagaatctgatatagcaaaatattcggggtttaagattttataataatgtgtaaacacaagataagaattgtgatacgcttcttttattttttcaccaaattttggttgataagatttaaacaaaatgtacgtgcatcattattattattatctacgtgtcatgataaaataagaagtcaaaaataaaattttatatttacgctgcataaacacgagatacgaatttagaaatatattataatatatattttatatatatatatatatatatatatatatatataatatatatatattatatatatatatatattcctaatatatatatatatgtgtttatatatatatatgttaggataaaatggatgagttcttagaatgccataagcaaaagataacaattgttatatatatgcttttcgatttatttgctacaatttggctgaaatttgcataaatagtctgttatttgtgtatagtctatgaaaatagtcgagaatgagaatttacatgtaaccctagatatggatatgcttatctgttatgtgaccaaatttggtatgagaatattccattaacggcctgcttcttatatattatctatgtaaattacacgtgcattatcatggttatatatatgtcatgataaaataaaaggtcagagtaatatcttatatataatgtataaacacaagatacgaattatatatgcttctatgtttcttgaccaaatttgggtaggagaatattagcataaacgacctcccagtgtttcagtgaacacaaaattcggtagcaaatcacacttactgttacgttctttgaaaaaaaatatgcagaaggaaggaggagaaattagaaattagtatgtaaaatctgagagaataggcttgtatttatagccaaattgggctgaaatctgaagaggctttttgcaaaacgcccatagaataaatgccatgacataattggctatttactcagtttcagcgaatacaaagttcgtagcaaatcacacttactgttacgttctttgaagtaaaaatatgcagaaggaaggaggagaactcagaaattagtatgtaaaatctgagagaataggcttgtatttatagtcaaagttgggctgaaatctgaagaggcttttttgcaaaacgcccatagaatatatgccatgacatgattggctatttactcaacaataaagagagaaattgaagggtagttaatttccgaagccgaagccgagcgaacgacgacgacagcgcgaggcttgccttcttctcaactctttaagagctagaagaagagcaattgcttcttatacattatctatgcaaattacacgtgcataatcaggttatatacatgtcgtgataaaataaaaggtcgaaagtaatatcttatgtaaatatataaaacacaatatatgaattatatatgatattctatctataattattttcgtaaatagtttggagtgagattttataacatgtaccacaaggtaagaattgtgatatgcttctgtttcttcaccaaaaaattttggtttgagaatattagcattagtctgctttttatacgtttatgtaaattatatgtcatgataaaaaaaagaaggaatgtatacataataactttaataagcttctcatttcttcactaaattctaatatgagaatattagcataaacggtctgcttttcaaatatctatgtaaatgtgatgtgtatcttaaaatatatatatttttatgtatatcgcttcatattttacttttatttcgtgaatttgggatgttaaatgtgatgatttatattaatttgaatgttttatgtgtaggaatgattcgggagcaattgggggcgaaacgtgcgaaattagagccaaaacgcacaaaccggacaaaatgcaatttgggcgccacaggcagtgcctggcgccacctgtggcgctggaggcagtggccaaaagttgagtagcgccctggtgggcgcctggcgctacccagagcgccggtgacgtgattttacccaattcgcctaggacacggtttattcaaccctagactttcccaactctataaaaggggtccaaaacctaatttagggaggtggaagatattttggaagggatctaacacactttgaaggagaattcacgtggagaaacactcacacaagcttggaggaggcttttacctagtttttcttctcttctcttctttaatttcatagtttattagttctagagttttggtgctatatgaacgttgtagtttttgaaacttgaattgttcttatattttatcatattggtttatttattcaatcttgcacttaattatttgatttttgatcaccaattgaataccatctacgaatctaggattgacctcggagagggaattctaaattgcatataatattgagtagagcaagatcttaactcttaaagggagcggatttgcggttaggataggaatatacctaatcgccttgcttggttattatacggaattataaatgcgttcttgttaatcctaaattcataggaatataggcgttaggttagcttgaataggcgagttgtacttcgggagaaggctacgagcaatattaaccctgtcaaccaaaacctgataaattaattaacgatttaagtgtagaaaactcgacgggattgttagctaacccataactctagaatatcggcccttatttaattcgtctctagaattttgctaacttgtttctttaattccttagtttgttactctagattagtcgtagttaaatattcatactttaggaattgcttgaatagattaattgtttggtttaatatagttgataattaatcacaagtccctgtggatatgatatctgaacttacaatcctatattaattggaccacgtatacttacgtgtgcatagggagcaacaaaatagcacgcgtattgtaatgatgtcatatacatataataatcgtccagcgcacttgactatcgcgatcgatccgataaatcaaagtatcctggccaaccgactaaccattgagaatggaataaatacgggagattgaattcttctattttgtctttcaacccttgcacttgcctcggctttatctaaaaaaataaataaaattagtcgaattacgatcatttgacttctgaatatagtctaaacatatacttttttgctatggttatagtttttaatgatcttatattatttattagtgtgtaaaagtttccatagcgggaaaaaatagagatataggatggtccaatacattttaaataatatattatgaaagatacaacaaatattgtagttgttacaattgtaatattactaagattaagtaaatttcaattatattttgaaataagtgacaaaattggtgagaattcattttcttgattatagttatataattatatctgatattgattttggcagatttagtaagtaaagttcttcataggaaaagaattcaataatttcctttaaagttttattagctaatgtgcttgatttttttcttttctatttgcttctaaatacataatataacaaataaaattagttcgttgatattctatattttttattacgtcgatatttttcgaagtgttagccatatagggatgataaaacgagacaaggcaaagtagggcggggcgtgtaaaacttttgtccaccaaagttttaacttgtcccgcccctctttattttatttttttaataatttataatgcaatgctttttttttcatgcactaaattgtaaaaggcttattgctttataccttgttaggtgtattaattccatataataatgtagagatactcacttcagaataattatatgagcacgcttccaatattatttgtacttttttaagttcctattttattatttatccttgtaattttccacagttgacaaagttggtctaatgagtttactctttgacggaagtaacattgactatagttcaactcattttgatcttatattgaccaaattagttgagttttgacaaatatatatatataataatatatatatatatatcaccatgcaattataatattgaggtttttaacactactataattacaattataggatcacatctacagcgtctagatgtgtaggctagctatcaaacaagtgagtaaaaatcacgagagatcaagatttaaattatagcaggcgatttctttatatctacttaagtattgactgccagagttatttaatatttaatatttaatatattatatatatatatatatatatatatatatatatatatatatatatatatatatattatatatatatatcaccatgcaataataatattgaggtttttaacactacatacaattatagtatcacatctagagcatctagacatgtaggctagctaccaacaagtgaataaaaatcacgagagatcaagattcaaattatagcaggtgatttcttatatctacttaagtattgactgacagagttattcaatatttatacttccataataccccataaaatagtcaagatatatgcaaattggttcaattaatctgtgctatattaaaagcacgaagatccttagtgaaatcgtttgcattctttaccatttaaaacaaatttcatactaaacaaaatagttattttaattattttcttcatatttaagaataattatttaattattttcctaatatttaacactttaaaattaatttaattgtatgtattaatgttttcttatttaaattgtataaagtatttataattcaatcaatcattattctctggaattatttttcacaataagtcaagttatattaacgtgcatacaactaaaacaaatatttttataacttcaagaggctttgtaacgacccgactgatcgttttgagcatttggcttccgttcagttattaggagtcttgattagttccgtataatgtattataagttatgatgtgtgtgaatcgtcgattttgattttcagattaatcagaatggatttggaagaaagattctcaactaggaagctttaagttggaagagttgaccaagtttgactttttagtatttgacctcggaacggagttttcatggttcattaggtccggatggtaatttgagacttggacatatgcctgaaatttcatttggatatttctataagatttcaacgctaattggcgaaagttgaaaatttgaaggtttgtaatattcataagtttgatcgaatgttgactttaaggatataggattcaattttagttccgaattggaataggtctgtcttgtcatttatgacttgtgtgcaaaatttgaagttaatcggagtttggtatgactcagtgttagttttgtaagtcagatgttcatagtttcaacaggcttgaattgggttgcgattcgttgaataggtgttgttggatatgatttgaggtttcgagtaagttcgtatgtgttttaggactttgtggtatggttggtcgaggacccaagggcctcggatgagttttgaacaagtttgggcatttcggtactttgattatgttctggagcaattgaagtgcggagtgcacatttttggagtgctaaggcaaagcccatgtgcggccaaaaactcccagatgtggaggcagtgaaaaatgtacggaccgcagtggaaaatgtatggatcgcaatggaataatcgcggaccgcaaaagggggaaatctgcaagcttgatggtctgccttcggaagcttatatttttttaatatataagaaatttggagatctaaaaatgaatgccgtagaactttgcgtttagtttccagaaagttataccattcatcatttggataattatagcaaacgttatggttcatttactgaagcctagtatagcagttactattgaagtgcgaccgcacaatctggatcgcgaccggcggaatttggaagtgcgggccgcacaaaaaaatgtgcagtcatcactttgggatattagaagtgataccatataaacgagggtttcatcttattttttatttttggacctaaagctcggtttgcggtgatttttatgagattttcaaagaatgcatcggggtaagtgattattcggttttggctatattatacgaatacatttttactttaatcatttaattagtgatttgagttgaaaatttggggaaaaattttgacaattcgtagactaaattttgggtgttgaaggttgggttgtgatcaaatttgagtaatttttgtatggttgaagtcgtggttgaatgggtattcagattttgtaacttttatcatattccgaggtgtgggcttcagtgttgatttttgagttgactttttgaccgtgattaagaatttagcatttttcatagggaattgattcttatatcttgtgttgattgtatcgaattatatgtggctagattcgaggcgttcggtggccaattcgcgaagcaaatgcttattggaatagagatttgcactgcttgaggtaaataacacttctaaacttggtgttgagggtatgaacccctcaatatacgtgttatgtgtttggtgttgaggtgacacacatgctaggtgatgggcgtgtaccgaaaaaattatgactcaatcgattctgtggagctttgtagtccaataatcttgtcattttccccatattctccatgtgttacagaaattgagctgtgactcatgttagaactcatgtttaggctatatgcttatcttgtgggaccaactggggtcatttatgttgttaagttatttgcttaaattgcaattacatactcattcattgcatatcatatctcagtctctattatcatttgtctcacatcattatttatcattgtttgggccgattggcataagatttgtgagaccgagagactggagagattgatgactgagtgagaccgagggactgattgtgacgatgcttatgggatcgggctgcacgtcgcagcaggctttatttgatttatgccatgattgacttatattagtgcttggacagaatccgcccctacggagtctgcacactcacaatgagcacagacacatattgagtgtgagtatgaagtgctaagcgtgagtgctgagagtgagtccgagtgattgggaggactgagtggctataaggaccgagtgactatgaggattgagtgattgtgagaaatgagtgactgtgagaaatgagtgactgtgaggactgagtgacacggaagactgagtgaagtgatactctgatagtatgcatatggttttatcattgtgttgcattgcatttgacatgcacacttgacatacatgcatagagatgttttttcctcatgatatacggtattacggcattcatgacttcacatacacattaacatataggtatagagatgcactttcctcatgctagacaagagatgtactttcctcatgccatctaataatgaaacatttacctattgaaagtttttggtagaagtcaaaattttcaaatttactcatattttggtgatttcagtgaaagatttggtttgctattatactcgaaaaacatgcatatttttcggaactgtgaacgagctgagcattttatttttgagttatcacttgtactgctttagttatattgttaagagttgttagtggttgttggtgttggactctcacctttgtccaagctcgtcactactttcaagctaatgttagttttattacttattgagtacatggggtcggttgtactcatactacacttctgcaccttgcgtgtcaattttagatgttgatgttgttgtgtatggcgggagctagtattgaagatgcacctgcgttccggtcatagctgcctcttgtccttggtagctttagaattattaaactattcatgtatacttcaacagatgatgtatttctttcataccaactttgtaaactctaaatcttagaagctcatgattcttaccaacagtccttgggaagtgtattaatgttcagatattccatcacttatctttctcagtttatcttatttgaattagattgttgttaattggcttacctaacggacaggattaggtgccatcacgactagttggattttgggtcgtgacaggcttagtctagaacaaaaataggaaatatattaaaaacaaaggcggatctatgatttgaagtttacgagtttctatagcaatcacaaattaatatacaataacaattgggtacacaatcaaatatttataaacatttagtgagtttcttaatacatatatataatctgcaaaaaagctactcggttccgtaaaaactatactctctattttataactcaaacacgactatcaatataatgtttatgtaatatataaaaaaatcgtattcattgatgggtacacacgcaatatgtgtacccaaagattagtaattttaaaaaaaatgtatatctattacgtgtgacacgttcaatattcttggggatgatttagtaagtggagtttttagaggtgttaatcgggtcgggctgacccgttaacaatccggttcgacctgggtcagcccgttattgtagcaaatttcgcgggctgggacgggttggacaggtaacgggttttaaacgtacattttttgaaaaacggtgcaccgaacccgctacaacccgttaagcccttaacgggttcttaacaggctgcaacccggttcagcccgttaacgtgtaaatttttttttttttaatttttgaccgttgccaataacattgaaaaagaaaaatataatttaattttttaaaaaaaagcccgacccgtccgacccgttaagcccgaacccgtacgagccctatagaacccgaaaattcctagcccgtcactagcccgccactagcccgttaattccagcccgttaacagcccgtcccgttatcgaacgggctgacgtttattatgtccaacccgtcccaacccgcccgttaaacacctctaggaattttacgaaaaaagaattagtattatattctgagtaaggttgttaagaccaataattgaatattcattgtgctgtacctacaaaaatgtcctctttttttgtttttatgtcaatttcgcacttaccttcaaaacttcgacctttccaaagtacactgtcttctcaatttcctaacttcaattcaaacttctttggtcgacgaacctttctttatcaaactccatttatacccctttatttccatacttatcatatatcaccagaattttcagttgttaatctcaattctttacaagaaatggcttttcaaaagatcaaagtggttaatcccatagttgaaatggacggttagatctttatgcttctttttcatttgattatttgatcttctcttgtatgtaactttctttaaattgcttgaaatttgtttgtacaaagttgctgccacgggttcaagctgtgaaaacagcgtccggagaaatgtagggtaaggttgtatataatacaccttgtggtccggtcttttctagactccacgcatagtgggagcttagttgcactgggctgccattgaatttgagtgtacaaaaagctgcttcagtctcattaatctgtaatatcctaattatgtactgattttagttcaagacttgatttttatgctgtttcttgtttctaaatagcttaattatgtactaattttagttcaagaattgatttttatgctgttttttgtttctaaatatcttaattatgtactaattttagttcaagacttgatttttatgttgtttcttgtttctaaatatcttaattatgtactgattttagttcaagacttgatttttatgctgtttcttgtttctaaatatcttaattatgtactaattttagttcaagaattgattttaaactgttttttgtttctaaatatcttaattatgtactaattttagttcaagaattgatttttatgctgtttcttgtttctggggaaaatggtttcttcttaagtactggaaaagaatatctctggaatcctttttgcatttttattcagtattctcaataatttttagaggttgtgatttcataagattatgactgattcttgttcaagaattgatttttgtgttatttcttgtccgggtggaacgggtagaacagctcagtccagtagtgagattgtccgttttgagcgttagtctgaacggctttaaaatgcgtcagtaggtgtaggagctacttgagtaagagttggaaaatttaattggctggagaagtaatactgtaatacaactgaatgtaaaaataatgaagaaaggtagaatgggatgggaattcaaaggaagatgaggaagtaaatatctcgccaaccaaatgtctacctgtcgaactactcctagccactgcttctttactaaccatcatctccaaattgaatcacgcctcccaggctcctaaaccccatcccgtacgtaatcagtgaacttcgtagaaggttgtttgatacacacacttgttctaactgctctagtttggcgttcattttagcttccaccacgtcctcgattgtggcagtctggtccctttggtttacatcactagggtgacctatttctttatatatcaacgtctctctgtgaggtcgtttggtagagtgtgttagtgaaaatattgaatgcattagctttgtgtattagtaatatcttgtttggtacactttttcaacctatgtataactaatacaagcattagttatacaccctacttggtattatcctatgtatagctaatgcatagaaaactatggcattagcaatgcaaaggctattagtgcatgcattagcatggttaaagacaaaattatccttaaagtcccttaaagttaaagaatatggagggcgtttttgtaaacaattaattttcttagaaattatgcaatgcttttaatttttaatacaccacaccaaacaatgcataagaaataatctctgtataactaatgcttgcattactaaccccagcattactaatacaccttatttagcattatatttatatgccctaccaaacgacccttaatgtgagattggtccaaggtgttacatatacctcgcattaggctcttgttaaggtttacctcaccactgtttaaggttgcattcggagtcccgctgataccatatatgacagcctaattcactagtaatattgtccattttgggcctaagcccacacaactattaaaacgcgttctagggtctaaagcttgtttttgtatatgcccagtgtccgtagtgtccgttctctgttttgtcaatgtagtatttgcctagagtgtcactgagggactctatattaacctttggaaaaaatgtctcaggaatctttctgcatttttatacactattccgccattatctggtggggattgtcgaccttgttgttgctcatgtgctaactgattgtctagaagaatacaagcgctctaattcctttatgaaaaaatgtttaacttctgaactcttgttagtaataatccaccaaatctggtttttcatggtaaattttgtaagtggagacttacaaaagtgtgaattcttaagttagaaaactttaagttcatctccaatggggctgaaaattttgagtattgtcgtagtaaaggagcatgatgaaatgataatcaacctacaaatgataaaagtataaaaaacaataagagttcacatcatgcgttatatctgataaattagtttggtcaaccacattactcattggttcttctaaactgtcaagaaatgtatttttttccttttcttatgttgctcttcctggctatgtgatgcaggagatgaaatgacgcgtgtaatttggaaattaattaaggacaaggtaaaaaagttgttttcccttctttatatggcagtaaaatattcgtgtttatcctctcgtgttaatttcacagttgctgatatatgaattctcttttatgctttagctcatctttccctttgtggagttggatataaaatacttcgatcttggtcttcctcaccgtgatgccacagatgacaaggttacaattgaaagtgctgaggctactttgaagtatgcattcatttctttttatcttttagtttctccgtaatgaaagaatggttgttttaggagcaagctcatacactgtcttgtcctaatctttccatggattactgaacgtcttctcctttatatgcctagccttattattttttaaactaataaaaattgcaggtataatgtagcaattaagtgcgcgaccatcactccaggtgtttactttcttgcctgcggttttttatcatttgaataacctgctggttttgtactaataatggtattcagagtacaagggtaaaaccatctaattacagtgtgatattagacatattcttttttaaaaaaataaaaataaaaatttacgtgtttagaaccaacatcaaggaactataaaatatgtgaatggcatttgcagatgagggccgtatgaaggagtttaacttgaagcatatgtggaagagcccaaacgggacaattaggaacattctgaacggtaaatctccatcttcacttgccaattttggtaggtgatatcattgtatgttagaattgaaggtagcgatgcttattttggtttttgttgcaggtactgtgttcagggaaccaatcctctgcaaaaacattccccgacttgtccccggtatatattacttcctgcagttatatatttgttatttgttcgcttaatactgtctttgacttacatagatgaagctgacatcaggttggtcaaaaccaatatgcattggcagacatgcttttggtgatcaatatcgagctactgatacagtaattcaaggacctggaaaactaaaactagtatttggtaaagtttttcctcatctctgtagttgcatatacctgtatgatttcggagatctgcttgatatttgtttgttctactctagtttggctacgagaaaatggttcaagttcgtttacaactttcggtgattccgttagaaaatgttgctgagatattgtactgaacctgattgtagtaccagaagggaaggatgaaaagaccgagttcgaggtttacaacttcactggtgctggtggagtagctctgtccatgtacaacacagatgaggtttgtttttagcgagacttctgagtgtacctaaaatagataagtagattacgctggagttactcatcttgtgctgctttttgctttatgtgaagtctattcgctcttttgctgaagcttctatgaacatggcgtaccaaaagaaatggccgctctatcttagcacaaagaataccatccttaagaaatatgatggaaggtacggctagccgtttctctgattctagtttctttgtacattcaccatttaaataggatttttgcttccccaccctccctttttattttggtttctcttctgatttttatgatcttttctgaagattcaaggacatattccaggaagtttatgagtcaaattggaagttaaagtttgaggaagctggaatctggtaagcacccggcttttcatttccaacaactggttcttgttaatgattgtaaatgacagagattgttaaatgcttgaattcataaaaataggtatgaacatcgcctcattgatgatatggttgcttatgctttaaaaagtgatggtggttatgtatgggcgtgcaaaaactatgacggggatgtacagagtgatttcttagcacaaggtatgcttggccaggttgctaaagttatccatctagtacacattttggagtttcaatatggaaacagcgtggaaaaaatacttgtttaattttcccttttacgtcctacttttgtgctcgtatgagcttgtaattgttcttaaaatgcttattacttgaacaggatttggatcccttggattgatgacatcgattctggtatgttctctatttgcttccacttttcccttcagctagttcctttgattttaaagcttttttcctcgtgattcatgtaatgattggttgagagatcgtttcttagatacagaaaattttagttttctagaaaataaggctcatcattcgtttgatcttttgtcgtcactgcgaatgtgctaccttattttggattctaattcgggaatatttggttcagatatgtccagatggaaagaccatagagtcagaagcagcccatggaactgtgacgcggcactacagggttcatcaaaaaggaggtgaaaccagcacgaacagcattgcctcgatttttgcttggactcgtggacttgcacacaggtaggacatttttggtacttaatttgctatgcttagagtcctaaggctttggcttgggtggtaagagcatagtatgtgatgtgtggattagacgcacacctggtatttaagtggagaagggtagagcatcacgtgcattatccctcgagttgcgatgcaccattgacgctcggggatttcttggttattaagaaaaagagttgctttggttagatttttaatgatagcagtactgaacaaataatcatgtactttgaacagggcaaagttggacaacaatgctgcactcttggattttaccaagaaattagaggcagcttgcatcggtgcggtggagaatggaaaaatgaccaaagatttagcacttatcgtccacggatccaagtgagctcttttactctttcttcttcatagtattttcgaatccgaatcaaccctttgtgctgtcattgccataattttgctctattgaaaccttatagggttgctagacatcaatatgtgaacactgaagagttcatcgacgctgtggctgatgagctgaaagctagacttctaaagcaaagatttaagtgtatgtttttctgatccaaaacttgtctttcttcctacagggatttagtcgtgactccgtttgatataatctaagatgtttttcttgaagaactaatttcttgagtttttttgtctttaattgttgaaaaaccatatagcaccagaaatgctatatgccgagtccgtggaagagtcggaccacaagggtctatcgtacgcagccttaccatgcatttgtgcacgaagttgtttccacggctcgaaccgtgagttcctggtcacatgacaacaactttaccagatacgccaaggctccccttcgatcttcactctttacaactaatgtttattaccatatctcacactcgcaccccaacgttttggaacctgattttcaaccccctgcctttgttccgcatatcctacaaccatctaattatctccttcatacattaaagttttttatatcgttatgttgcttttgtaatcgtcattgttctttcttttgtttcctgataggtctcgatgtagccgaggaaattgcgccagaactttgtgaattgataaataagatgccattcctatggcagagttataccattttagctgtgaaatttactcaggaacagaattaggaggactataactatattatgctctcttttattcaatttttcttcctggactttaactccggctgccagtagaaaatataaagaacgtctaattctattttattattattgtttttaacttatgaatattagactgagatgagcttgaatttagcaatatggatagtggcgattcaatagcggattgtaacttgcttgggattaaggcataactgttgttgttttacttagttcatgactaatactatgttcagttgattctaaaaatctatacataagaaatttagggtaatgtttcacattaatgcatataagtttatattgaaattagtaaatagtaatacaacatttggtttgtggtattgaactcaacataacttatgctggggtttaattagtatttcaagtctaaagaaaaattattattgatgatccaagaacatatatattgctaaaaaaattgctatttatttgttgaatagacaatcatgactatgcttaataaaaaaacattgagaaagtccacatacggcacaaacttttattgttgttggaaaaagaataagtcctccaaaactaaaataatttttttttttttttaaaataaaataaaataaagttgcgtacgatagacctttgtggcccggttcttcttcggaccccgcacatagcgggagcttagtgtaccaggctgcccttttattttacaaataatttttgtgaaaattttctatcaaggcttggactgatatgaatgtgcatttgccttattacattattcttgttttatttattagttgttgaggcgtgtaagttagccgcataaaataatcaaaagcgccacaaaataattttagatacatatagtatgattttgattaatttataaataaataaagcaaatgattaaataatgctaaaagttatggttaaccaatttagacaatgaactaaacttatattggtctgttttcataagtgttaattattatatcctgttgtaaaggagagtgtcacgcgcacaaaagttcacttaacttcttatttgtgaaagataagctgctaaaacattctattacaggattctctccctttctagaatcttccactgtttcattgcttcctctttcgcttctcgcgcttagttttcatctggttggactggttgtttcaggctagattacaaatcctatcatggtattagagaaatcgagagaattagcttcgagtttgggacttgtaaccctaattttgtatgatttggtgcaatttcactaactctatggtgattgcagatgaattgagtggtacgacaactagtacatcaacaaccattaatggactgagtggcggaatagtagctctcgatcacaaccacccattgtatattcatccattcgattgaccaagatcgatgtctggatctattgttgactggtatggagaattacactctatggaatcgagctatgaaagttgctctacttgaacaaactttgtcttgttaatggttcaacatccaaaacagattttggtacaaaatcggcacatcaatgggaccgatgctaagtccctttatggacttgagcaaacctcacgacagtggaacctcaaacttatactacttgcttacctcaggattctcatagagtcatttcgactattccttattcactaagaaagtggctggacatattgtggtggtttgttatatatggtgaccttctcattactgggatgatttgagctcgatccaagagacaagacatacttcagaacaattttaaaatcaaaatctaggagatcttcgatactttctgggcatcgagtttgcaaggaatagcacagggataatcatgcatcaaagaaagtacgccttggaattgatatatgggaatttctggtactaggtcttttggcgctcttatggaacccaatcaaaagctaacaactactgagtttgatcaacatgttggtcctgttcccaccactgatcctgttttgcctgatcggggcaccttccaaaggttgattgggagcttattgtacttgactgtcactaggcctgacatttcttttgtagtttagtgcctaagccaatttatgcatgcgcctaaggaatcacaagagcctggctttgggatctttctttctgcctctagctctgcctcattggtggcatattgtgatgttaattggaccacttttcccaatacccttagatctattactggttttttttgtgaagtttggagattctctgatctcttggaagtcaaaaaagcaaagcaatatctcaagaagttcgcgggggttgagtatcgaagtctagcttccacagtggttggacttgtgtggctcattggtctgtttggggagtttgatattgagatgtccctccatgttcctctgcattgtgacaacaaatctgccatccagattgccgctaattttgtttttcatgagcacaccaaacacatagatatcgactatcactttattcttgagaagattcaacaaggctaatacgtacgtgtctatttgtctttttctgatcaacatgcaaatctcttgaccaagggattgagtaggcttcaacattcctatctggagtccaagctagggatgaagaacatctttatttcccctagcttggggagaggagtaaaggagagtgtcacgtgcacagaagtcacttagcttacttatactgatgtgcatactctgtatttaaccttagttgttagactacagttagtagcagtgagtggtcacttgtttagttagttagcactcttagctggcaattagttggatatgttagtcggtgtatataaattgtaacttctcatttgtgaaagataagttactaaaaattctattacagaattctctccctctctagagtcttccacggtttcattgctgccttttttgcttcacgcagcttcgtcttcatctacttagattggttgtttcagcctagattacaaatcttatcacctgtcgagatgtcaaatatactagaattatttcatgtaacttttacaatatcattttacaacaagctaaatcttgaaattgttcaaaaagcttgtatattcatgattacatttatcagcgattacttttgatggcgactgttgaggtcgccacagaaatgttccgtcactcttcatgacatatatagtagtaacttttgtataagtcgtcacggaagtcgtcactaaacactttggttgcccctacataaggccgagatattagctgtacttttactagcgacaaaagaatcgccacaaatagtcgttactaaaatttggtcaccactataaagggcgcaaaaaacagtcgtcactaaaactttagtcgccacgacaaaggggtgacatatatagcagtacttttgtggcgaccaaaaagtcgccacaaatagttcactaaaacttttgttgccactgcaaagggtgacatgtggtggtgaccaaagagtcgtcactaaaactttgctcgcctctatggggtgacatatatagtagtattttggtggtgactaatgtgtcgcgacaaaatattgtcactaaaactatggtcgcaatacttttaggaaaactgtagtagtcaccaccaaaagtcgtccctaaactttattagatcgctaactaacttacttttagttgtgaatattagaagtcgccacaaaaaattttatacacataatgctttaacaacaacagacgtgaaaatgagttgttgaagccaaataaatcgttctttaaaatatgtttttcaaataattctttgttgtaaaacttatagtaattgtggatgtccactactcccactactttcacttatgatgtaaataacctcccactacttatcacttttatgattgtaactcccacacatccataacctctcccatgatcttccccatgatcttccctatgatctcaaaggttaatgtcattgtttaatacaatccttttgtaaccttcaatgtaatagtataaatagaggcatgaaatgtgataagggatacacttgaacacttgatgaaataagaaagttatctcttcttctcttattctacttatattcttgttttatattgttactttgagctacatttcttaatacgttatcagcacgaaattgagctcgtttcgttgttcagtttttacgatgtcgagtttgtcaaaacttgagtttctggaacttggcatttctgaaaagaattacctatcatgggttttatgctgagattcacttagccgctaaaggccttggtacaccattactcaaggtaatgaggcatcgagccaggacaaagcgaaggccatgcttttccttcgtcattatttggatgaaggtttgaaggttgaatatttaacagtgaaaggtccaccttgaattgtggactggcctgaaggaaaggtatgatcaccttaaggctacggtattgccaagggctcgatatgagttgatgcacttacggttgcaaaattttaagaccgtaagtgagtataactctgatgtatctcgaataactttccagttgaaattatgtggagatgttatgaatgataaagatttgttgaaaagactttacgacttttcatgcctcaaatatatactgcaacagcaataccgtaaaaagggttttaaaaagtattctgaattgatctcatgccttctggtggctgagcaacataatacctttttgctgaaaacttatgaagcctgtcccacagggccagctccgcttcctaaagcgaatatggcagctagacgtgataagtctgaaaaaagacagaatgataatcatgccatatgaatgtacgtgggcatggcaatggtagacgatataatagtcatcatcgtggtggtcatgggaaacgagagataatatgggttctcaaaacaatccttcaagaggcaaaaacggtaactgccaccgatgtagcatgaaaggtcattggatgattgaatgtcgtgcacctgagcattttgtcaggctttatcaaaacttcatcaaaagaaaggcaaataatgttggagcatcttctgctagtccccagtggagtctcacttgacctttaaaaacatattcaggtccttcaaacaaaaatgatgacaatgccgaggcaaatcttgctttgaataatgatgattttaaggcctcgatgatttactcatttggaagttgaagacttctttggagatcaaaactaaagtttgatcattttactgggaatgcaattatgttgttatttttattttcagtatttttttctctcgttttaaagttgtttttatgttcaagtagtacttaagttgttgttttacgtattcgttctcatgtgtacttttattttattttttatgaagaaaataaaatttctcagtcttcaattggatccaagatagataatgaagatttaaccttttggatagtgctacaactcacacaatattaagagaaaagaaatttttctcttttttggttatgaaaaaggcatatgtttattggtagtacaaagttaattgagggctttggaagaggccttctactacctggaggaacatattaactatataatgcattgtattgtagtaagtctcaaagaaacttgttgagtttcaaagctattcgccaaaatggctatcatgttgagaactataacgaaggaaaggttgaatacctttatattactaaaataaaagcgggaaaaaacgtgtgcacgaaaaattacctgcattttctttggattgtaccacactaacattggtgtggttgaatcattgccatagtaaacaaaaggtttattatttctaataactttatcatttggcatgaccggttagaccatcccggttctaacatgatgcgcagaataatagagaattcaaatggaacatttgaagaataagaagattcttcaatttaaggaattctcttgtgctgcttgttctcaaggaaaattggttactaaaccatagcaactaaagttgggattgaatcccctgcatttctgaaacatatacagggtgatatatgtgggactatacaccctccatgtggaccattcaagtattttatggtcttgatagatgtatttacaagatgggacatgtgtgcttattgtcaactcgtaatatgacatttcgagattgttggcccaaataataaggttaagtgcataattcccagattatgtaattaagacaattcgtcttgataatgctggtgaatttacatctctggcatttactgattattgtatggccagtggaataaaagttgagcatccagttgctcatgttcatattcaaaatggtctagcagaatcattgattaaacgcctccaattaatagctagaccattgctaacaaagacaaaactttcccttttagtgtgggacatgttattttgcatgcagcagcaattgtgcgcagaaggccaaccagttatcatgaaatctccccattacattgtggatgtctactactcccactactttcacccatgatgtaaataacctcccaatacttatcacttttatgattgtaactcccacacttccataacctctcccatgatcttccccatgatctcaaaggttaatgtcattgtttaagacaatccttttgtaaccttcaatgtaatagtataaatagaggcatgaaatgtgatatgaggtacacttgatgaaataagaaagttatctctttctttttatattctacttgtctcttgttttatattattactttgagctacgtttattaccattcttatttttaaatttattttgcatagaatttttatgaatttttttccaccaacatttttcaaaaattcacacctaagaatatagttgaaatccaaacgaaataaccgttcctcgtcttctccgccactttcaggccatttttttctcttcttcacatataagagcttaaccaattaattcctctaaatcagttcggcatttccaatggcgtcgttctccaatccaagtccccagctctctcattctcctcacaatctcttctccttcttccctccgatcttccgccgcggcgggtggcattcccagctcgccaataacaccccgctgtccaatcgaagatccgtgagattttcatgccagtctcagctctaccatgaccgaaggcaaaattgtctcctggactaagtcgagggtgacgtcctctccaaaggagaatctgtggttgtcgtcgaattgataaagctgacatggacgttgagacattctacgtggcttctcgctgctatcgttgtcaacgacggcgagaccgctcctgttggcgctcctattggtctcttggctgagactgaagatgaaattgccgaagccaaaattagagccaaaggccaatccaaactagaaaacctctcctgctgctaccactaccagtgatgctgcagctactgctgcccccaaagttgctccgcctgatggacagattaagattgtcgccacgccttatgcgaagaagttagcgaagcagcacaaagttgatatcaataaagtgacggggacgggggcatttggacggattacccggaggatgtcgagaaggctgcagggattactcctaaaagcatccccgctgctactgcagtagctgctgctccgatcccggctgcaaaagcgtctccaactagctttcctgacattccagggtcgactgttgttcctttcaccacaatgcaaattgcagtatcaaagaatatgatggagagcctctctgttcccacattccgtgttggatatcctgttagtaccaacgcccttgatgcgctgtatgaaaagtaagttcatctacagtcaaacctctatttaacaacttcatttgaatgtattatgttgatgcatcaaatgctggggtgggaatttcatagaaacggcaaatgaactatacctatttgcatttacattctggtgcttgacatgctttaaattcaattaataacaggttaagccaaaaggcttacaatgactgcattgttagctaaagctgcagcaatgccctggctcaacatccgttgtgaacgccacttgtaaagacgaaagagctttactataatagcagtataaatattgctgtgctggcaattaacggtggattattcaccccggtgcttcaggatgctgacaggtagcgtaattacattctctatttagaaggaacattctcttcgctgggtggtaggagctcgagaaagacgtaaagtttagtgatacaatgcttatcgttttgttacctggtgtagtggatctttatctattgtctcaaaagtggaagaattggtagacaaggctagggctaagcaacttcagccacacgagtacaattcaggtaacaatttgctttatttgattgtttgtcttaatgtacctctttgagtactgacattgaaagttttggtttcaggactttcacgttgtccaacttagcatgtttggtgtggacagatttgtgctattctcctcccggccaggttagaaattagatgtagcattctctatttctgtttacaagtcattcagttcttaggaagtagcgactattctgaaactgggataatgttcaggggctattatggctgttgagcgtcaaaaccaactgtgctctgactctgaaggtttcttctctgtcaaaaatagatctggtatgtcttgtatccagtttctgtttcaagctctttgtttcttcctctcttttgttggtcgggttagagtgtttagttggaggagaggaaaatcacaagcaaattttagttacataaatgctcgctcttattttattcgcataacttgcatacccatcaaaaaaactaaatttgtttagttttgatctgaattgtgtgaaagccattactatatttccccttgaatgtgaaagttggaaaacagaacgtattacattcaccatctgcctattgagacctaagaaccttggccttccttcaggtgattgcaatagaaaatccctttacttgtttttcttcaacgtttggcggcttcgagaggattttaataataactgctttgtccttgattctttcttctattttgggtctcatatcttgtttcattattaaattctttttcaataaactcgttcgtttgtcttgtatagtttccactttttaacttctagttaaaattgattctccgaaaatcacacattgagcttatgaaatactaatgttatcaatgagatatcctcaaagatttattacccacattcatcctgacatagccctgctattcttctacttcattagttcattcctattcttatctgttgcatacaaagtttcctacatgagttgtaaccgggtgtccagggaggtctataacgttcttggggagtccactcatagcctaaatgtgttcggtagagtgctcagattttttcactaattcctttatttatctcgtgatcatggtccatggtcttccgcatttgtgtaaatatatgatcagttcctgtacctgtgaaatcagtggccttatgcagtgttatcgaaaagtgcaaagagctctaatgtcgcttggagctgtaagcgcaaagcgcaaataaagcgtgagctttaatgaaaaaagacacaattggagaaaaagtatataaaaatatgtatatgtagtctaagtctaataattataagcataaataacaagtatatggacaaagaaattgaaaaaaatttatgataaagtgaaatatcaattatttaatgtcgcattttcaagattacattcattggcaagcaaaagtatgtcttagagccttgatgtgacactaaagagcccacaaagtgaggcgaagcgctcaacatgttttgagccttgctttagggcttaagcgcgtctttgacaacactggccttatgattgcttaatttattacaacaacaactacgcctcagtctcaaacaagttggggtcagcgatatggatccttacttctttctttaagctcaactcatatcgtggtcattacaaaaacaaaatagaagtgaaagtgaagaataatatatatatatatatatatatatataatgagttttgctaacctactgcatagttatagtaggttagcattgtatgcatattgtagttctccaaattttaggaatttattatttgctctcacattttagctcctttgaggagtttctatttatcccttatgtggtgtctgaacgctatttataccttctatttcatgtgatcatttatgatataatctaatcttgtatcatcatgcatccatcttaacattaatttctacaatactcaccttgtagtaagtgatggccattaagaggtgagaaacacactcccatatagtattggtagtctcctctatgtagagcttgcctctcatttggagaggtattttcgtatcgtatatatagcattttctcaattttgctcatactatttcagttatatacgtaacatatacttctatcttttgaaatgcggagtctagatatttgaattgtcatcgattagacatctagtcctgtctaaatgcacttttgactcatcctccttatatacataaagctagaagatatagctttatataaagctatagtcttgttggttcaccaatcaactacatgcatcatcagaccatttattaattggttatttccttgtgcttgtacatttcttggatgactcctcctatatctctgcttcttcaatggagtcttctcgaacgaactgcaaacttaggcatgagcgtaatgatatttggctctttggtacagtccaattttaggctggctgtgttgcttgaaagagagtacattacaactgtaattaatctcaagtacaatcatttgaatgtaaagtaaagacatgcttatcaccaaaggatcccttaaccaatggtctcaggtccctgggtatggaaaaattcttggtagggagtactttctccgaatagggtcctatgcggcgcgaatcggaatatagtcgggctccaatgtggacaccagataccggatgggaaaccaaaaataaaaaagtaaagatatgctttgaagcttaaccggggcactgcaataaaggtgcgtgacataacgttcttaacataacctccttattacgttatgcaggtgaatgtcacggcggatcatcggattatttatggtgctgacttggcagccttccttcaaacattctcaaagattgtcgagaatccagagagcttgacaatgtaagatgctttcaatcaatagtttctgactgttttctgctatgttgtactaaaactttctgattatattgcattcttgatattttttggaataggtttttcccttttgctgatttttggatacttttttctttttggaaattctaaatattaaaccggtaacagtagtggggtgagattttacctcattctatttatcgagttggcaggtgactgacgaaaactgatggtcatattttaatatctatccataaaaaaaatagggtagtgtttcactctgtttggcttactgccatgagaggactgagcatgtccgtctgtctatatatatatatatttgggaaagagctgaagatcatgaaaagcatttccgcgcaaggaggcagaagaccgggaagctttgtttctagaatgccgactacatgggaacagatgttatataggttgattctaattctgtaacacctcaacctttagatagagttccaaatcggcaaagcacaagaggatgctggatatataagttaacaagccttagactctagtgacgtattttaaacccgtgagggcctaggcacaaagcagacaatatcactagcaggccctgctagtgatgttacgaattcatgctgcccgctcgattccgaagaaaaaagggagggcttgaccacaatttctcgagtaagagatagaatttcactaattggaaggaaaaggagggcttctatccattgtgatccggtttcttagtatggagagatctctgccataaaaagagagctcctaagccttattctgcggatcgaagccttaaatgagaggactgagcatgtcatacatatacatatatacatatacatatatatatatatatatatatatgcagggtttaataccgaaaatcaaacatattagtttcattgtaattatatttagttatgcaggattcaaaataaaagaccaaacattgcataagttatatgaaattttaatcaagattgaaattttctatacctcaaaccgttcacgatatcaagtcatattaatttttttttcctttttaggctagcttagcccaatattcattaaacttacatactaatttggattcgcgtaaaatagcctcgttaagggtaatcaggggcgaagctacgtagtttcaagggtggtcagttgattaccattcatcgaaaaattacacggtatatatagataaaatattagattttagtgatatatacatatattgaacaccctttatcagagatttttttacttctttcaaatttgaacaccctagatgaaattcctggcttcaccactaagagtaataactgagtggacgtaaatttttactatgaaaatgctcttttctaaggtgttctcattgttagagttcgaactcgaaacatcgggataaaggtaaaggtataacaatttcaattgtccctctaacttgaaatgcagctaaagtaaaatacaagaaaatgaaagtcacgcaactccaaaataaattttttaaaagatttctataaattaaagaaaaaattcacatctaagaatatagttgaaattactgaaatataatgtccaaacaaaaaaaaacaaaaaaggaaagagccatcaaaagccccctctctcgtacagggtgttttcattggtgcgcactccatttccttctctttttctcccctttcacatttcgaattgactcaaaaataaaattttagatatttttataacaaattagaacattctaatggaacaaattaagatcacgaaagtagttttcatacactttctttcataggcggagtcagtatttgaagcttacgagttcggcatttcaatcattttaaattactgatttctaaattatatatctatatatattcaataaatttttaagataaatacaaaacataaaaaaaactaagggttcgaccgaacccgcatctgacattgtggctccgcccctggtttctttcacctagcggtagagctgaagttctaatggtaagttctataaaatctaataattttgcccaagatttgtaatattgtaaaatcctctaagtatgtataaataatttattcaaaattcatcaagctgtcttattttagaatctcaaacgcataaattcaaaattatgaattcgcctatgccccaaataactaaaaaaatgagttaataatacaatactctccggcttctaaatgattatgatttctaactaattaaaaaataagtgatttttttgttgttttcacacatattaagaaattcaccttttaacattaattagtaatgaaattgaccatattaacctttattatcttttcacataaacacttctaacacatactccaatattaattacaccaagggcaatataagaaaaataataattaattcattcttaaaatctgacaaaattgcttattttggatcacaaaaataaataaaaaaaatcacttattttaaaccggagagaataaattatataaatatttttttatattatcagctcttaaaacttaaactcttaaaaatatcatcagaattaattaatatgaacaatatcgcaatggaaggtctttttccaagtactatgagagatttgacttttcaaagtatctctttaatgtgcagtcggcaatgtagaaatgtctaaatattgttgtgaggtttactattcatacttgactttttcaatataaaaattattgtttttataataattcagattcacgtcacgtatagatgtcgaatcttaagtcttctggttaaggatagttagaggggttcgtccattcacgatacttttgacatataagcactttcaagtttattagcaggagtggaggtaaaagccaagctacgagttcgcccgaagccaatagcttttactcaaaaatatttgtgttaagaaatttattaaatatgtgtacatattaaatttagaagccatcattcagtacaaatcgtcgttctaaaattcagaacccgacgttatttttttacttttattaagtatggttccctttattgaattcctttaatattctaattaatcacgattcatgtgtgcatgtacacacatacgcgtaaaggtataaattaatgacagaaacaatacaaaaaataaaaatattatgaatatttttttttaagtcaaacatccctttagttgcactttcaatatgggttttttctcaatattatactaaaatataacaatataaaaagtttgctatacttgattagattgaatatcagaacaaaagtcaatttaagtatttttgtaagacacaaaaaatatacatatttatttggcaagagttaaatgaaatattccagaaccttttttcatttttcaaattttctaacaattaaatatcgttcaaataaaaagaagaaaacttatataggatattaataatcagccaatgcaacgcggagaattgaaaatatccatctaactaatagtccaaagaaaggaatatcaagtcataccgtgctgatatttcttcgaggtattatcacttttagctctgcgagaattttttttattcggtagcaataaaagtatataaaatttatataattttttatataatatgcagaatgtttgtgtatatatatatatatattataaaatatataatttttcagcaattattttgatagcggctatacaatatcattttctctatttcttctttcttacctaataatttttaataagaacctaatattctatccatcaaaacttaaacgaattaaagaaacacttgatatattttgttaccgcgaaaatttaaacgctaattgtttataatttttattttactttattaaccactaaatcacactatccaataataattacatagtctccttcaatcatggcgtcaacccagccaagtggtgtctgtgtaaagcgacttctttaattaaatgataatgatagtttttttttattattattttttatatatatttttatattaataggtcagcataagctttggatcatgttctttagccctccacccctgactagggtcaggggcgggtttataagcaaatacatgggacactgaattcatgatctttccgttaaattatgtattttatgtacatattttttaaaattggtctagtattatcttttaatggaggaataattgatattatcttttaatcatctacttttcttataacatggacaaagaattttactttttacagcaaaaaaaaaatagtttgtcttttattttttgatttatattattgcactttttaagataaaatatttattttaaaaataaaaaataaaaagaaatatacgataaaatatgattggtagttggggatattatttaattattaacatgtgttaggtgaggaaaacttaattatttaatggtccttgtgggattggttaaaaataaattattttgtatatatattctttaatttatttagtatccaccttccttttattaaattaaaagagagatgtgggaggtgtcaagaagctaacctatcaccgacgtttccctttgcccaggcagtcgcaattaaatattttttattttttcgtattttttgagacccgattaatttgaattcatgttgaataaaaaatatttagtattaaacttttttttattctcacaacttgaacccgaaacaatttagttgtcaataaggaaggggaggagggggggggggggacatgtgcgtatattggaggttggacttgtaattcttaaacttttattttcaaatttaatacgaaatttgtgtaaaattaaatattcatatatgatttcaccaattttcagattagcgttcaaacatatttttttttatcacgaaacacggccttaagtcagtttgggttaatataatataatcatcatattacttttaagatattaaatccttaataaataaataaaaaaacatagttcaattcctctaaaaaaaattatttttgattaagtgattagcataaactttggagaagaacatgtcaagttcacatttatttcttctttaatatatatataattaataaaagaaaaaaaaaatcatgagatggaccaaaaagagagtggacaattaaccaatttatgctgagaataaatatcagaaaaatctatggaataaaaataggtgtcactttggggagggcgaatttaaaaaattattatataaagtattgcagcaattttattcataaagaaatattctttcaaacataacttgattagctgtaagttcccttctaacaaaaatagcaagttgttttaaaaaataataagttggaagtacaagcacttgtatataataatatattaaaataaaagtggtaagttaaataaaaaaattaaatttataaaaaacttctattttagcagcagctttacaactattacaaccataaagttaaacgtcttatatgttaaacttgactttaaatattaaattctcactaacaagtaccatcattattcttttttattttatttattttgtctaatcactttttaaataagagcccgtttggacataagaaaattttcacttttttacgaaattagtgtctgaatataaattttacggttttcagttaaaaacaattttggaatttttcaaaaagttgtttttcaaaatttccactcatatcactcgaaaaactacaaaaacaatccaaaattatttcatgtccaaacagaactctagttttcaaataccattttcacttaaaaaaaaaaattatttttttcataattttataattttcttatgtccaaacgtccactaagtattccttgattcttaattagatgttttagatccgaaatttaaatggtctcgcttttggtagaaaacattttatcccgaaaggggacctcctgccacaaaactaaattagttgggcccgaaaaggaaaaagaaaaaatgatattgtatagactctttcaaaacaataaccgaaaaaatataaccgaatatatatatatatacaaaaattatataaattatgtatgctttttcgactattaaatataaataaacggttaaaagtgacaaaagtagtaaaattcaataaagacgtgccagctcttccacataataattccaagtttcattatttatttatagtgatacaatattcttcttcaagaaaggaagaaaaattatctccctattttcattttctctcctgttttaatttctgatcttctccgtcgtactaccaccactacgccgccatggttctgtccaagacagcgtcggaaagtgacgtctccgttcactccactttcgcctcccgatatgttcgaacttctcttcccaggtaaatatattacgtctcaatcttaaacaagttacgattaatttatatatttttcgaatttttttaatattttttgttgagaaaaaaattatttgaggaatatagggaaaattcatttttcttacttttaacttcagatcattgtgttgatcaacatttcgacgttaccatcgatctttaatactcaaaatttcaccactatcaatttgcttatataattattaaccattgatctttcacccgatcatcaaacactaattttttttcttcagaaaataaatctatttttgaaaaaatattttttaaaaataacccgtcatactaaacacattcttttcattttttactgagccgagagtcttcgaaaacacctcctctacgttcacgaggtaaggatgagatctgcgtatatactatacgctcttcagatcctatctgtgggatttcaccgtgtatattgttgttgtaaaccaaacacacccattatgagcgtttggacataaatctcagtccaaaaaaaaaaaaaaaattcgaaatgagtgtttgttcataaaatttccaattttcacttgaaaatgcattttgaaaattttcgaaaatttaaaaaactcaaagaaaatactgtttttcaaaattttcactcaaatcactcacaaaacttaaaaaactacccaaactgaattttttgtccaaatacaattctaaatttcaaataccattttcacttaaaaaaattttcaatcattttttgaaattttacaattcttatatccaaactcctactaggttttcttttcctaagattttctattgtatattcttgaaaatggagctttttttttttttttttttttaaacttttttattttgtttttttggatttttaggtttaaaatgccagagaattcaataccaaaggaagcagcatatcagattataaatgatgagcttatgttagatggaaatccaaggctaaatttagcatctttcgttacaacatggatggagccagaatgtaatacgttaatgatggattccattaacaagaactacgttgacatggatgaataccctgtaaccactgagcttcaggcaagtcactctctctctctcttctgatcacagtgacggagatagaattttcgttaaacgtgttaaaaaagaaaaaactaaaagaaattatgacgggtggaatgcatttagtggttttaaaatacaaaatataatcggattctgtcttatataaacgatgtaatttttcagcgaaaaaagttcgagttctgccctcctaaatccgcccctggcttatcgtgttaaaattattatacatggtcaagacacttataatagagtttaacttatatacatcgacataaaaactatattttacaaagtaaactttcataagaagtgagatatgtaatcttgaaaataaaataagtttattataaaagataaaggtgatgtgacagtgtatatatgtttaactcaaaattataaataaatatgtataaaagtaattaagttgataatatgataaaaatgatgtactaattaagttgctaaataagttaaattactgatttgtaaaagatcttttacactatcgtcaatgtgtattcttctttctcgtattatttggtaataataactgatattttctccgagtcaaatgagttcacataaattaagtcggagggagtataataatggtaactaaaacttctaagctaaattacacaaatttgtaaaaaatcttttaacttgaatcttctttttcgtttttttttttggtaataatagtagattgccttattgtgacttttgtggcgcaaaataggggtggcaaatgggcgggttgggttgaatttgaacgggtcaaagaagggttagatcaataaatgggtcattgcccaatcaagctcaaagtgtacttgggctaagatgggttgggtcaagatgggctaaacaatggatcataacccaacccgcccaacttgacccatatttatagaaccatgctcatcttacaaaaaaaaaagtcttttaccttaaaatgtgtaagttgaaaaataatttgcgcgggagaattgaggttagtgggtggtgcagaaaaacgaaaaaagaaaaacaaaaaatcgaaaatacaaaaaaggtaaaaaaaaaaaaaaagcagaaaataaaaatacagaaaacaaggtaaatttttttttgagggggtttgtgcgggggtggagggagggtgcgtgatgcagaaaaaaacaaaataaacagaaataaaataggggtttgcgcgccgcggagcgggggcaggatgcgtggtgcaggaaaacaaaaataaacagaaaataaaaatacaaaaaaaacgtaatttttttagggggtttgtgcgccgtggtggttggtgtaggaagtagggtgggtggatggtgcagaaaatttataaaaaaataagtgaaatttaggcaactaagtaaatttctagataagttgggttgagatccctttgatttgggtaagtttcatgagttgtatttgggctgcttaataggtcagaatgagttataaaaattaatgggttaactgggctcagtccatattatccaaactaaaatattgtaacccatttatctctgggcaaattggacgaattgaatgggttcggcttgaaattgccgccctacttttcacaaattcaacgtcttttttacttttaataagtatagcgttaggagataaaatatgtacaaatttaagtggtactcaaacatcataggcccacgtcttccttttttggttcctacacatgcaataatgcaaatcatgtccttcatataagtactataccaaaatatcttgggactcccataaacttaggcacagacgcaaagccgggattttaaatttatgagttcgaaatttcaatctttttaagttactgtatcctagttaataatttataaatattcaacgaattttttaaaacaaatataaagtttgaatcacaactattggattcggtcaaatctattcccgatactctagctccgccttaactataacacgttttattcaatgcacacactttcttcaaagacccctcccgaaaaaaataaagaaacatgccacactatatatatatatatatatatatatatatatatatacatattttttactatattcactttactaaaaataaatattgatttttacttatctagtttaaaaaatcaatggataatttactgttttatacctagtttactcttcttataagtactagtacttatttccaattcatttttaatatataataaataaggataatatagtaaaattattatgttatatattattccctccggtccaaagtaagtgatcttttgatctttttttttgtggtccaaaataagtgattttttcagatttcaagaatgaattaattatttttcctacattgcccttggagtaaataagtgattttttctttcttgtgttttacattttactctaccgacatatacgatggcttttgttcttcttttttgggttgtaatattaattttctaaaagcaaatataaattaaatattatagttattttcgtagggatttctagtcgttttattttaattttattttaaagtaccaaagtagaagtttaggattttcattttttttctttaaaagggaatattctagaatcaattttacagtcgtcacaagaaatattactaataagcagttactttctctaatttcagttaatttgtttaaattaaaatatgattgtaagaagtttaaggtataatatatggataatttgtgtattatgtgtatataattaatgctaatttatatattattaaaaaaaataataaatataaccgactatttgtgtaaattaaagatccccaaatttttaggggattttcaaactaaagtgaacgaatgaccatatgccacaatttttctaaacataagactttctaccacttgtgatcttatcccctttacatattggaagaagttcaaaaatagccaaatttataagtgatgattaagaaatagccatattttaaaaagtgatcaaaatttagtcatattttatgtaaagataaatttgaacgaaaatactattcaaaatccggaatatactccagcataatatattggagttcaaattttttacatgttggaagttcatacacaggtcaagtctccagtatattatgctggaactttctgtgtgctgaattttcagcacaatatgctggaaattcattcataggtgtaccaatttcaatatattatgctggaactttccgtgttgcagcaaaataatggctatttttcactgactttgcaaatgctggctatttttcaattaccaatctgaaaactgattaggccatactattttcacttacatattatgtaaactcataaatcatttaataacattatatatatatatatatatattataatatatattatatatatatgcaagtatgttgacttttttatattgtaaatttcacactttaaggaggcttacctacaaatatccttcgagagtctgagtgacgtgataacgaaaaaattctttacacagacgatgaatataacttataatcgaaaattatatcgacaaattaagaataaattttacattattttaaatatttttatttattttgcagaatcgatgtgtaaatatgatagctcatttgtttaatgcaccacttggagatggagagactgcagttggagttggaactgttggatcctctgaagctattatgcttgctggattagcctttaaaagaaaatggcaaaataaaatgaaagcccaaggcaagccctttgataagcccaatatcgtcaccggtgctaatgtccaggtgagaaacgtatatttttagccgctcctaaaaaataataaataacaatatattatatttttggtatgcgtgttttatgtacatatttagtaaatgcaattagtttcagccgaccaactaattttttttttgccctattttatatctagtaaatgcatttagtttcagctgaccgaccattttgtattttgcccaatcttagcctatcatgatctttacacaagtagccaatcaaattcattgcttactttttttagctggtatacatagattatacatcaattatacatatattttacattcaatgctattttagtttaaacggctgggtgggcagctaattaggttagttattctaactttattatatattatatacattgacactatacctaattttgttaccataagtgtgttttaatatgttgtgataggtaacatatgttactttcgaggctactaattcgatttcttatggactgttacctgtatttatctttaatttacttgataatgtagaattttctttacacggttgcgtagagaagttaaactctataaaatatatgaatttgtttccaaaatttaggagttgagaggggctaatttgtaattttaacaggtgtgttgggagaaatttgcaaggtattttgaagtggagttgaaagaagtaaaattgagtgatggatactatgtgatggaccctgagaaagctgtggaaatggtggatgagaataccatttgtgttgctgctatcttaggttcaacactcaatggtgaatttgaagatgttaagcgtttgaatgaccttttgattgagaagaacaaagaaaccgggtaagtcgcgatttcgcagagctttttggttgttaagttatagcgtctgacggaacaacatctaataattccgatcattctggttcgcactatacttaagtcatctttgaagagtatatctcttcaatagtatatcaatcgtatgcatctaactatcaacgtaggccgtcttctaacattattgaaaagaaaataagggagtcttggagcaacggtaaagttgtttctgtgtgacttataggtcacgagttcgagccatagaaggagtcactaatgtctgtgttaaggtagactgtctacgtctaagttgctcgaactcgagtgtgggtttctgatacgggacgtatccaagtatcggatccgacaaaatctaaaatttaagattcggggtcggatccggatatggatacgggttcgggattcggttaataaaaaatcgagctataaaaatattgtaaattttgagagatattctgtgaaaacttacatggatattgtagaattcaatctttcattctccaaggtgaacattattctttcattctccgacatctgctttagttttgattttgagaaatcaaaatctcaatttttctcctaaatttgtcgatggactccggtcaaagtgtctgaagtcagttgactgaatccgggacttatcctgctcacgtccccgtctcgtatcgggacgtggacagcaccaaaatcaaagagtccgcgcaacttaggtttacatcacaccctttgtggtgcggccctttcctagaccccgaatgcacgatactttatacgccgagcttttttttttctatataaatattataatatatggttgataattggtaacaggtgggacactccaattcatgtggatgcagcaagtggtggatttattgcaccattcctttatccagagcttgaatgggactttagattgccattggtgaagagtattaatgtgagtggtcacaaatatggtcttgtctatgctggtattggttgggccatttggaggaataaggaagacttgcctgatgaacttattttccacatcaattaccttggtgctgatcaacctactttcactctcaacttctctaaaggtaattccttcattacaagtccttaaatatgtgaataatcgtatacgagccaggatttgaggttaatgagttggggacttgctattatattcataactcgtcaaaagtcgagtccagatgacaccattcttttcttcgaaagtggaattttggagcaacggtaaagttatctccgtgtgatttaaagggtcacgggttcgagcaatggaagcagacgctaatgattgcattaggctaggttgtttacatcacactccttggagtatggtacttccacagatcctttgtgaatgcatgatgctttatgcaccgagctgaccgttgctatcttaaagcatatgatgctacaattagctagatatgaatatatttgtaacattgaaaaataccacttgaattatatcactaaacttacgaatttaatcattttttgctattgtaatgcaggttctagccaagtaattgctcaatattaccaacttattcgcttgggttttgaggtaagttaagattaattttgatattcacaggcgtcttgcctatgaatatcatttgaatgacatgaatataagaaacttgaactctaaaaataatatccttttcacaaccaacacactttaaatatactctttacaaattgaaattttcgaaagtaaagcctcggcgtaactggcaatgttgctatcatgttgaccagaaggtcattgattcgagtagtggaaacagtctcttgtagaaatgcagggaagactgcgtacaatagacccttgtggtccggccctttctccaaccccacgcatagcgagagcttatgcaccagactgcttttttttacgatctgaaatttctatgttaaaacagggttacaagaatgttatggagaattgtcaagaaaatgcaagggtattagagaaggaattgaaaaaagtggaagattcaacataatctccaaagaaattggagttcccttagtagcattttctcttaaagacaacagtcaacacaatgagttcgaaatttctgaaactcttagaagatttggatggattgttcctgcatatactatgccaccaaatgctcaacatgttacagttctcagagttgtcattagagaagatttctcccgcacactagcggagcgactggtaagtataattacgtctcagttccaaataagttgatgatgttagactatatgaatcgtaatttcttcgttttaacttataattaaccatttacgagtgtttttcgagcgtataacttacaaaaggaaaaagacatcttcttgtcttgcatctctatcaaagtatcttttctcttttcctccaaaaacactcctttctctcacaattctatttttaaaggactcgtgtacaatgtattccgcgttcacgatggatccgggaaagagttacatccaaggggtttgatgtaatagtctaccctaatataagcgttagtggctgctttcgcagctcgaacgcataacctataagtcacacgagacctataggtttcaattctattcttaaaaccctaaaatatgtcttgatttcgtaacaaaaaattctcccctattttattagtacaaaagttcgatagacttgtggatatttattatagtacttgtgttcaatcctatagcaatttcttttacgagttttttcttccatataaattgattctttacatgcaaaagaaaaaaaaatcttcttgtctttaatttgcatgtattatcaaaaaatctttttgcttttcctccaaaaacacttctttcttcccaaattttatgtacttaaacttgaaatatgccatgctttactaaccaaaactctccactatttcattagcatagaaattcgaaagacttgtcactagttatatttactagaagaattaaccataatagcagttcagccagcggatagataatatatgtataattaatgtacaaagactattaacgttcaatcctaatcttttgtgttttacattaatatttttccgattcaaacaggtaatagacattgaaaagtcctccacgagctagacacacttccggcgagggtcaacgctaagctagccgtggccgaggcgaatggcagcggcgtgcataagaaaacagatagagaagtgcagctagagattactactgcatggaagaaatttgttgctgataagaagaagaagactaatggagtttgttaatttaatttaacaaaaaaaaagtttataatatggtgatttatgtaactactagcagtcgtactgcttgttttttatatttgagttgatgtgttttttgagcacttgaggagctagctagttattgctagtgaaaaattggatgatatattttggactactttgtaagtttgtattattaatccaaattaaacgatatttatcatgcatgtgatttataaaaaagttgtgagtgcttgaggtctagtttactcgatatgattttcttttattactagatatgaaaaacttgtgatcgatcctttatattcgaacattatatacatgggggcggggcggaggtagaaaagtccagatatgagttcaagtcgaatctagcttttacgcaaatagtttatttatattagaatatcattatctattacctattgccacttcaaccttacaaaacacatattccaatggtaaacacttactcatactctctcttcgactctctctttctctcctcgaccaacagtcgacttcgaccatccccctctctctccgacgaacatcctccacaggcgagccgacgtcggcctctctgatcagcggtcctagttcccttgtatgggtcgaaatccggcttacaaaattcggcgtgggaagattgttaagtgagaaaattatgatttaacttcggcggttaggccgaggtcggccagtgcccaacaatgataatcgatgagcaagccgataaagctgaggtcggcagtgaagaataggaataacgactagtatgtaagactcattctgataagaactcttgtgacaagttgactcttgagatataatacaaaactttacctttccacagtgattgattttgttgtttattctatccttccactcacacgatccgagaaagctttgtccattttcatattcatttatcacacgttgttgtcagagggaagaatcatccacatcattcaatacttgggtgaaccgttcttcttatttacatttattgccatttttcatacttattgctcattcttgccccttcatttattcaaaaagcttcatttaataatctgataattagttttacgtactagtggacgtcactgtttaggcatgtgactagatctaagatttattatgcttgactaggatttacttttcaccttatttatcttgtaattagtttagcaaaaagtgtcatactttttggtcaaacaattgggcgccgtctgtggggattttctagtcaaaatcatagtttttctagatctacaaaaatcacaccaacagccaaatattgaaccttgtttttcctatttgcacgatctaacatggtaggaaatgaagaagaaagaagaaggcagtgacagaccttaccgctaatctcctaagcaccaccaatgagattcacggagaagacgaggagaacgtgacaccaagtggttcacccctccctcatggcagcgttaccgcctcccatggaaaaggagcctctacgtccacgactgaagaagcatcactaatggtgaaaaaactactagaatcttggctaacgagtacacttaacaatatactcgacaaacccgctcaaagagtgagtagggaggatgaacgagtcgacatcataataacaaccagtgagcagcacgcccccctccttcaataagtatcactcactctgttaatgatgcaagtaatgatgccctcgctgctatcctaagaaaaatagaggagatggagaatgagaacaaagcactccgcgaccaaatgagagagcaccaacaaagggtggataagatatcaggcgcccaaaactcctaccaaagcgggacgccggccggtttgtggaacaaccgtatagcgacgagaccgcaccacatgctataccaaaaaaattcaagatgccaccatacttgaagatatacgatggtacgatggaccctgaggatcacatcatccactatgttaccgcagtgaaaagcaacgacctcactaaagagcaaataccatctatattgctaaaaatgtttggcgaaaccctaactgggggagcactgacatggtattcgcaattgcccgcacgatccgtagaaacatttaaggagatggccgacaagttcgtcatcgcccatgctggggccaagaatgcagaagccagagtgaatgatatattcaccattaaacagtcacccggcaaaggactcaaggacttcctcacccggttcaacaaagtgagaatgacccttctaaatgtgtcagagggaatggcagtagtagctttccaaaacgggctgaacaggagcgggtcgagggtgaccaaaaaattgttgagtagactcatgaagtacccccaactacttgggaagaaatacacaacacttattgtgccgaggtgagagcggacaaggacggccttaacggaccaacccagcggttcacgtcggtccatatggagtcgagaaaagaccgtagaagggatcatgtaggtccgcgcctcaatcgcgaaagacaccggccatacatcagaactgtcgtcgcaccactcctccccttgccatggtgacggcccatctagtccgcaaacggggactcaccgaaacgaaagaggtatgcctccactgttatctcctcataatttttgtgtttctcctttagagatagtctattctctagagaagctcggccctaaggtgaaatgtccacaaaagatgaagtccgacccaaacaccagaaagtcgaatgcccgctgtgaattccctcaggactgagtccacaagactgaggactgtatcgccttaaggcaagaggtagtaaacatgctccaccaggggtatttgagagagctgatgagcgaccgaggaagagtgaacttcgctcgtgggcgagagaacatcaaggcctgcggaagctgtcctccccagcccgcaccatccaaatgatcatggcagaggcgacgacacgacaatcaacaacgtgaaattcacaaccatccacaagttgaagcagtcgatcacccatgaacggtatgacgacctcgaagaaagtatcatcttcgatgagtcgaatacccacggtttgatctttcctcactatgatgctcgtgttattacttaatgaatttcatatactgatgtaaaatggattatggtagatgacgaaagcgatgcgtgtaatatccaccctagagttctcgcacaaatgaggctcgaggataagatagtaccacactgcatcacactaacaggttttaacaatacagttgaacggacctccagagaaatcacactacccgttctagccagtagtatcaccttggaaacaaagttccacatcatgaatcaagacacggcgtacaacgccatcataggacgaccttggttacacgccatgagggccatcccatccagttatatcaggtcatcaagtttcccaccccttggggagtgttcatcattcgcggcgagcaacgcacagcccaaaaatgctaccgcatcgcccaagattgcacgtacacctaacagttgaaaaataaaggcatagaagcacagcaattagcgaggtcgaggtcagacggtgacaaatgaaaagatgtcatcaaaaacctcgagtcgtggaagccacgagatcaactgtggaagacctcgatcccgttcaactagataaaagtgaccacaacaaaaaagcttttatcggccacaaacttcaagaaccaagtaaattccataaatctttaactgacaacgcaaactttgccttctcccatgcagatatgctaggcattccgaaggaaatagcaacacacaagctgaacatcgacccatttacctgccggtacgacaggctagaagaaaattcaatgccataataaatgatgtcatccacgaagaggtgggaaaactgctcgcaaaaggctccataagggagtcaaagtaacccccaatgggtcgccaacgtggtcatggtgaaaaagaaaaacgggaaatggtgcatgtgcttggacttcacagatctaaacaaggcctgcccgaaagattcatttccactgcctcacactgatcaactcattgacacaacagtagggcacgagctgttaagtttcttggacacctactcggtctacaactaaatcctcatggagaaggaggaccaggaaaaaactactttcatcacccaccaagggatgtactactacagggtcatgccgttcggacagaaaaatgcaggggcaacctatcagaggctagtaaccaaaatgttcaaagaacagctcggaaaaataatggaagtatatatagacgacatattggtgaagtcgaaaagaaaggaagatcacatcgaccatctgagagaggccttcgacatacttaggcgatatgacatgaagctgaatcccgagaaatgcgcctccggcgtaacctcagaaaaattcctcggctttttggtgtcgcagagaggcactgctgttaaccccgaccaaatcaaggctatagagggaataccagaaaacttgaccagcaagaagcaggtgcaaaagctaaccagccgaatagccgccctatcgaggttcacatcactatcctctgataggtgccacaaattctttagcgtactcaaaaaggacaacagattcaaatggaattccgagtgcttcaacaccctaagagaattaacggcatacttgtcctcgcccctgctgcttgctaaggcggaacccggagagcgcctcctaatctacctggccgtgtccgacgttgcagtaagcgcattcctggtccttgaaaacaaaggtatgcaatctccaatctactacattagcaaaaccttggttgatgcaaaaacaaggtaccctcaccttaaaaagctagccctggctttagtcgtagcttcatgaaagcttagaccatatttccaatgccaccccatctcagtggtcacgacctttcccatgaggagtatcctacacaaacccgagttgtcgggtaggttggctaaatggaccatcgagttaagtgagcacgatacaacctatcagccgtgaacaatgataaagtcgcaagtacttgcggacttcgtcgccgacttcagtgctaaaataatgcttgaggccgaaagggaagccactaatacttcctccaagttacatgacctatggattctatacactgatagagcctccaacgcatcaggatctgaactgggactcgtactcgaggtcccgacaggcgaagtaattcgtcagtccatacggtgtcccgatatgactaacaatgaagctgagtacgaggatgtgattgcaggattaaaactggccctcaaatacggagcacgacggatagtcctccgatgtgactcgcaactcgtcgtcaatcaagtcacaaggacttttcaaatcaaggaacaaaggctacaaaaatatcaggccgagatctgcaagctgctgcccgagttcgatgaatgccagctcgaccagatacctcgagcacagaacatcgaggccgacggcctcgccaaattagcggcagttattagaagcataaatgaataagagaacgtggtcacacttctccactcaaccatcgaccaaattgagttaccactattaaccttacttgggactggcgcaactgtatcatcgcctacctgcaggacggcgtgctcccaaacgacagaaaaaaggccaaaaagcttcgaatgcaagcagccaggtacaacatcgtcaacaacgacctatataagagaatgtattgcggccctctagcaaagtgtccgggaccaaactagacaaggcgtgtcctagaagaggtccacgaaggtcactacgaggctcacatcggcaatcgagcactagtcagatgtctcatacaagcaggctactactggcccacaacgcaaaaggaagcagctgattttgttaaaaaatgtgaaccatgccaaaagcacgtccccatgatccatcaagtgggcgagcacctccactcagtcatgtcgccatggtcattcatcaaatggggaatggatatcgtcagccactcccaacaggacgaggtaatgtgtgatttcttttggttttaactgactacttctcttaatgggtggaagtaagtgcattcgcccaaatacgcgaacaagaagtgatcgcctttatatggaggaacatcgtatgccgttttggcattcccaaagaaattagttgtgacaacggaccttaattcatagggagaaaggttgctgagttcttcgagaaatggcacatcaaaagaatactctccacgccatatcacctagccgccaacggccaagctaaatcctccaacaatacaatattgaatatcatgaaaaagaaactggaaaacgccaagggactatggctagaggtgctaccggaagtgttatgggcatattgcaccacaccaaagacaagcacaaaggaaacgccatactcactagtctatggactgatatataatgtcggtcgaggtcggggaatcgagcgtaagatattcaaatgaaagcgggccaaacaacaatgagaacagattgcaagatctcgacgaggtcgaagaacgaagagacatggcctacataagaatggtagccgaaaaacaacaagcagagtgatactacaacaaaaaatccaaagtcaggccactcaaagccggggactacgtactcaaagtcaaaacacatgcaggcaaagatccacgggaaggcaaacttgggaccaattgggacagccctacaaaattatggcggtagtaagcaaaggatcgttccaactagaaacaatggagggaaattgttgccgacaattggaacatcgctcacctcaaatacttcaacttctaaagacaagacgtcctacaagtctactctttttccctcacccgagttttgtcccaattgggttttctcagggaggtttataacgaggtgacgaagagggcatctcgaagttaaatatcagttcatcgctcgacctctcgacaggttcttcaggtcgaccaatgaagggactagatagaatgggatttctccaatgcatgtacgaacagagcaaaaatatgtaaacttctccaatgaatgtataaaccaaacgaaatatgcaaacatatgatgttcacgtgtccccaccaagtttacacattatgctaacccaggaaataacattcgacctcattcgaattaattcaaagtcaatattcgacctcgctcgaatcgactcacattcgacctcgttcaaattaatgtaaagacaatatttgacctcactcgaatcgactcacattcgacctcgtttgaattaatctaaagccaatattcgaccttgcttaaattaactcatattcgactttgttccaattaatttgaagtcaatattcgacctcgctcgaatcgactcacattcgacctcgtttgaattaatttaaagccaatattcgaccttgttcgaatcaactcacatttgatctcgctcgaattaatttaatgtcagtattcaacctcgctcgaacaaactcgcattcgacgtcgttcgaatcagtttataagtcgacgttcaactttgctcaaatcaacatatgattcgacctcgttcgagtaaaattacaagtcgacattcaacctcgaactagctcaacttacattcggcctaagtgaaatcgaaaccaagacagccaattgagaaaaaaacattcaaaggaaaaataaaaagttcaaaaatagacgacaaaagtattatcattccaaaagtcatcttacaaggtccggacaagttcccgcaaaaccaaaaaaaagaagaaaagaataacaaaaatacaaagataagcatactactcggccgcaactccccatcgccatcgccatcggtgccctcgccattggagtattctttgtcataccaagcacccggctcgagcccgtccaagtcatcttcattatcatccatcccgagcatgccgggtcatagccgcaagcgtcacgagctgcacgtgcctcaacacgagcatcctcgaactccgcctcaaaagctttcccggccgtcatcaaacccctatatatatcaagatgaccctcggcatgaacccatttctcgtacaaatcccgtcggacattgggataagtggaagcatgggaggtagacggatgagcctgttgctgcaccttctttcccttgaggacgacaatctgctcgttcggatctgagacctcgacttctagaccaccgaatcgctcttcgagccttgcctatttaagtgcagatgtctctaattcactagccggctcggatctgaagacgctgatagtacccgctagtgtcacctcctccgtcacaacagtcgttttggctttctctattctctccaactcttcagctttggaagcaaactcatctcttaagacgttggctccagcttcactctgctcgagctcgacctataaggataccacctgagcctcgagatcgaaacactcggccatgaccccttgatcacctcgtgcatatcatctttggccctcaacatcccttcgagctcgctgcacttgcaaatggctctaacaagctcatcatcattctcaccaagtgtgttgaccagtgcacggtgcttggtacggtactctctatttagactcaatcctctaatagagagtcgtcctcttctccttccgacgagcgctctcaatctctagaataagaatatgataaacaaacgaggagaggtcagccaagacaagtaacgtaaagaaaagaagaaattaatacgctaaaagagacaacttactcgcagggccatcctagaaatgcttagtgatatgtccgcgtcttttagcatctgtagagccctattctcggagtttgtgcataggggagccaaagctggaaccacacgctccgagttgactaacagattaaaatccacggggataacaatatttcgagtagaccccccgatcctcacttctactcgagtaaacctgcccccgaaggtctgcacctcctcgggatcgatatcagaaccagacccatcatcatccataataaccttttttcctctaccactgacggacgaagagccgaccttagctgcccacgatcatcccttttccgtagcagctttcgctatctccaacagcctctcttctgttgtcgcgcccctttttctcgcgaaatcggtttcgacacgtgaaaactcttcttagggagggtatagaaagagagagtcgccacataacggattaaggtgcgttaggcgcctatttgtaaataactcaggtttactagttacgtcaccaaagatcgggtaagggctcaaattaccttgaggagaaagtgttaggcactcctcgaggtccacaactgtgggtctcggccgaactcgaattatatgaattagtctaagaaaagggaaacaatttggacaaataaacgatttactttaaacagaatttgggggggggggtcctaagtcttttagcctaaaagatcacccactgcaacataaataatatttcattactccctcaagacggggtgttactcatattattcgatattcagcgggcacaaactatcatctcctgctacccttgctatttttaagttgtttacctaaagctctctattcaattctaagtcataccctatgcgtgcactacccgtcccatgcctatggcccaggaggcatttggacctctatttcagggtggttctagatctcaacttaggctgctcaaaagggaaaatactaagtgacatacaaaacagttaaggaatttcaaatataagcaagtatgggctcaagttagcccccgcatttagacaacaaatgcatgccaaagtgattaaattgacagattttaattaattaaagatacataatcctataggtaggatttctatgtgatattgaacgagtgagcagacagtcatgcacataatctagtttcttaatacgattaccaggatctaaataaatttgcatactgattttagcataattagattaaacctactagcatgattgtctaggtgtttcacgcgataataaatagtggcaatcacagaaacatatctagaattacttgttctgatcctatagaaatgtttttctaatgagggtaatagcgcagtgttttaaaaaaaagctcctgaaccattggcaaaatgataattaaactgattcaaacctataggcatgctttctacaattttgatctagttttagatcctatagacatgatttatataatttgtgaacagaacagcatgtaaacaagattttggcacacatattgaaccacactatttcttataagcatggtctctaacaggcagaaaaataaaacactgttaaaccacgtattgaacctatgggcagggcagctagcatataatgactgaacataaaaaaatcctataaacatgatttctaacatacaacataaaataacacattatcgaacctataggcaggatttctacccaacttgttgcaaatataagatgaaaccctttccaatttcactaataccccaaagtgttattacaataattattacagacccagaattgaatgtagtgaaactacataatagatatagctatagggagcctacagcaaacccaaatacacctggacaagctagaccttcaattcacaacagctctagaatttcatattcatagatacaatataaccaattgttgagtgattcacccagtgagaatatgtcaaggctgaccataaataacccaagaccctagtgtgttagagttcccaagggcttcaagaacccagggcagtgctcacactagggaggttgatcagaaataattcagggaaagactagggactaatcctagtgtgtcagagttcacaagggtctcgaatgaaccctgagcagtgctcacactagggaggtcaaaggcagaacctaagtagccttacctttcagccggttaaaagtaaaattcagggtccatatagtaaaggaatataatgaagtcaagggatctcactgaaggacagaatccatattgacatatacaaacaaataccagacatgcttaaacttaagacagacttaatcaagtttcaggaaatgaattcaatcacgtgctaacaagacaaattacaaggcagacttatgatgataaaaaaattcagatttggccaagtgcataaacttgtgtcataagaagaaattatatcaactagcaatagatcatgacatgcaaaactaattagggcaattactagagatcaagatatgataaaacaggatcaaacatgccatattacagaaatttcataaaacaaacttgttatctcattaatggatatatctatacctagttaactaatccatagaaggacatatgagaacatgtttaaagagaaggatcataacaaacttaacttcaagtgacatacatgttaagcagaatcaaattaatcaactcaaagtgggtttaaacatgtctcaaactactaatgtaatagcatttaggttagcagagtctaatttaagtaacccattaaacaaatgacaaataatcagaatgaaatggcaaaggtcaataagtcaccagttaaaatgaaacaaaggagaaaggaatcgcacagtattgtgaatatcaccaaaaggagcaagaaatcagaatttctggctttggcttccaggcggccaagaatcagagtacataacaagattatttcagaataagcagcttacaactttacctttctttaatgatttttcgaacttaatcaaaggggagtggggagggttttaaatggcgtaggaactgaacacataaacatggagaacaattagtttaacactagaaaggcaagcatttgaatcaataagaaaggaaaatttaaaaaaattctaattttgggtaaaatacacaagtcggcagaaaataaaggcaaaaagaatcacatattgcacaagatgaacatagacataaatattattcacaaaatcacagaatcggaccagatttggttcaattaaaaaggatttgaaaccttaattttagggtaagcaaaaaatcggcagaaatagacagatttacacataataaggtgaatatagacgggataatacttatcaaaggcttgaaccaattttggttcgaatcaaagaagatctgtaaaccctaaccttagggttaagtatgaatcaacaagatatgaacaaatcggactcacatggtgcaaaaataagcatgtgtggactcaatatcatccagattcaagagacgaaggtcaaataggacaaatcaaagtaaggatacttgccatgtgtaggcaagtattaggtaataccgtaaagaatcacccaataatggaaatatgtgaaatggtaagtaaggaagaaaatcccattggaacaagattaggagatgattttgtgagacggcatgctaggtttctttagagggggagagtagagaggtggcgggtttggggaaatggggttagggtttgtggacggtgatatatggaaagggggaatgcttgtgagccattgataattgttgatcaatgactgggatttgagcgggggttgggtcgggtttaatatgggtaagggtactgggttaatggtgttggacttggggtaattggaatatgtttgggtagtttaagtccggaattaactgtgaaattaggaccagattttaaatatccaattttaataaataaataatttataaaaatagtagataaataaccaaaatatcatttgtacatacaaatgattaaaaacaatcatttgacattataaagatataaaaagttattttctgtatagataatgtaactatatgtacatatgggttattattgcaaaatgtgcaatttagcattaaatatgaaaatgtaattataagaaatgcactaaaaatatttaaaacctcatgtgggtgtaaatgataagttgagatgataaaacatcataaaaataattaagagggtaattattggatatttatataataaaatgcagaaataaattgatttaaaatctttaaaaatcatgaaaaattatgaaaaaaacttgtatatgcttgtaaatcaaatgattatgcgtatgcactattttgaaagtatacacatatatttggaaaatatgagggaaaaaattgggtatcaacatctacggcaacctctggcgggggaacagtcccccaactgaaagacacgccgactcaacatctagaataactggccgctcaggtgtgtcttcaacggcaccacctcctcctcgccgggagaagattcgtccgctggtgaagtaccgggcatgtcgggatctccgctgatagaatggatgtctaacgaccaggttcgcttaacaccggagtctgggaggaagtattccgcacatactcggccaacacgaactgcatcccggcgaggcaaccgcctggcgaaatgctggaacgggagccttcgcctacttagaagccctctgacctgacaacaaaaggaaaccataagcaaaagaaagaaatggactacaacgagggcgaaatagttcaaaagccaaaacccgacttaccggtcgaggggcttgggcccgaacctcttgttgaaggacgcccagtcacggatcccttcggtgtgaggcagggcgcgggccacccagtcactgatatcggcgaccaaagaagggggatgtctctcggctacacgaaggaaaagaaaacaagtcacgaaacacggagagaagtgagagtacgtacttcaaataactaggacacttacgagcaaaattctactactcaggaaacccgttagatttcgccaccacgtgcttagttttgacgaagaaatagttgaccaaaaactggcagttcgtcttgtcgtccatccctgcccactagccctttggttttgcggtagcgaaggtgaattatcgtgcccctataaaagcttggcttgaagtgatccggtaagtgacagatagaaactccacagccatccagctctgcaaacttcgtcaacatgaggaagactttataaaggtaggggaaaagttgtgccgggaaaacgccgtaatagcggcagaactcttccgccaatgggggaagaggaagagaatagcccacttgaaacgggtaggcataaaatgtgcagtatctgggctggtgaatttgaatcacgtcgtccccggctggaaccaggtcaacatgagcaggaatgttatatttggccctaagggtggccagatgctatgtctccatcccagacctcgcgggctcggggtcatgagcaggttctttcaagaaatcagacctggaagttgggttacgagggacaacctcctccacagtggggaagcttttgtcctccataaccatggattcccctccaccagaaattatggccaccgataatggattagggttagagacttctcagtgttgggagccacattagtcatcttttgcttatgttcaaacggtggagccgaaaatgaagaaaggtggtgacggtataagttgtaggaagtatgaacccaagaagaagaagaagaagcaagtgcataattatttctcattatttccccttcatttgttctaaacatcttcatttaataacctgataattggttctacgtactagtggatgccactgtttaggcacgtgaccagatctaagatttattgtgttgattaggatttgacttacaccttatttatcttgtaattagtttagcaaaaagtgtcatactttttggtcaaacatcccctccaccagcgatagctccataaggcggccccctccacgccttgcccatgttttactccctccctttctgtcttttcccccatttctcctcttcttctccttgcggctattttttggggtcttgttaattactgcattcatcgtacctgctccagcatcgtgtaagtgggcaaccagggctgccaggttagtgggtcaccaggtttggtggtgacaaccctctccccccttttggttttcgtggttctattgtaattttttgggtggatagtcatggcgtatgggcaagcaacacacgtcacctccggttggcgttagcaagggatgacgggaatttggaaaggagcacgacaagttcctcagtcttgggtgtacactgatccaggttctattcttgggagttggtacctcccgttctctggtttcccttcctcttatgttagcttgttgatgccatatttgtcgatactagtctagttagaatattagtagatctgtagatacaacatgttttcttcgagtttagtccgtcacttgttctgtgttagtgatttccctttatctaccgtaggtatactggttgtggtctatgatggtagataaggtcatgtcctcgggtagggtaagaggcgggaggggtaggggtaggggtggggcagggggcaaggtgtaagggggcaaggttgcttataggttgagaattgggtcgtggaatatagggacgttatcgggtaagtctatcgagttggcgaagatttctccaaaagagaaaggtcaatatagcttgtgttcaggagactaggtaggcaggatcgaaggcgagaaatgtagatgggtttaagttatggcactcttgatgctcgaagggtaagaatggagtgggtaatttggtggagagggatcttagggagacggtggttgatgttaggcagatgagtgatagattgatggctattaagttagtggttggagggctcactctaaatgtcattacgcttacgctccccaatcgggcttggatgaagagtttaagaggtgcttctgggagggtttggatgaagtggtgcgtggtattccacccatggagaagttatttataggaggggacttcaacaggcatatcgcggcatctgctagtggctatggcgaggttcatggcagctttcattttggggttaggaacggatgtggcacttctctcttagatttcactaaggcttttgagttggtgattgcaaactttagttttccgaagagggaggagcatttggttactttttagagtacagtgtctctgactcagattgattatctcctcctaaggaggtgtgatggagagttgtgcaaggattgcaaggttatcccgagtgggacactcccgactcagtgcaggatcttggtgatggacgtcagcatcgtgataaagaggaggaagaatgtggttcagggtcatccgaggattaggtgggatgccttaccaaaggataaagctcaggagatggagggaaggttgttgtctttagggacccagaggagtagtgaggatgcaagcggtatgtggacgatgacggtgaactatgtaagggaggaagcgagagaggtgttaggggtctcgaagggttactcggggtcacaagagcaactggtggtgaaacgtcaaggtccaggggaaggtggaaaaaaagaaaatggtataccggaggttagtggagaatacagacgagaaagagaggcggttgaacagagatagttataaggaaggtaagaaggtggcgaagttagtggtcacggaagctaagaatgcaacgtttagtcgtatgtacgaagaaatgggggacaaaggcagggacaagaagttgttccggttggccaaggcgagagagaggatggatcatgatctggaccaagtgaggtgcatcaaggacgaggaaggcagagtgttgatgaaagacgctcagattaagcggagatggcatacgtactttcataagctgctaaatgagaaggggacaaagacattatgctaggagaactggaacactctatgagtcatcaatattttggctactataagcgtattaaggtcgaggaggacgtagggttatgtgtaagatgagcaggggctgagcgatcgggccagacgaaattctggtagaattttggaggtacgtggataatatattacgtaattctttttatttttatttgaactttatgatatagggtattcatagagataaagaaatgaatataagcaccagacactatccatagacaaacatctatcctgtttaagccggtagcaatttactgctataatttaacgattttgaggctatcaaggcattatttcagagtgaaaaagtgaatagtttggaaaggtgacagaaagttagagccaaaaaaatggaagtaagaaaagaaggaaaacaaaacaaaaaagtttctaaaaaaaaaaaaaatgcaaggaaaaataaagacaaaaaatttccaaaagacgtagttcaatattaatgggatctttacacaaatagaaatttatcgtttttttttttatatatatataagtatacataattatatacatataatacataaataggtatatattagtttaagtggttggatggatgactatatgagttaattcttctatattaattacacaaaagtagaaaattagagatatatttacaattaagtgttacaatatggattaagagttccaatccaataatatataaattttaattttaataagtaggtactaaaaaaggaatatttgtaaatttaataatatcttttaataccacgcgaagcatgaacagattcactagttatcatataaaatggacctagagaatatatggcaaaagttgataaactaaggaaagtctaacccattgacaacaaatattaagtacctattattaaacaactttattttgagatcttaatatatatatatatatatatatatatatgacagagagggtgggaaatgttatgacccaagcccatgtctgctttgaccaatagattcagtaaaaatggctcgtggtaactactaaataaggtggtgtttattttttatccaccaattttaatattgagcaaaaatagctattactctattaaaattaatttggaaagataatttttttcttttttttattctcaaacccttcctttatacgcttctgtggatttaatttgagagcaaatttcagaggcaaaatttcgcttcctcagtatcagtatcgttccttgcatgcaaatatttgttcgattttgttctgccagcccacagcaatcctctgtgtgtagtttgttcaacttaatctcttctcctttgtcatcttctctgcatcaaaccagcgaactaatatgttttttttttacttttatgcatttttctttttgtatatccctaatcgcgatcaatattgtgtttgtcatcaagtacgtgtgaaatatcgaaaataatgattataacttgattcggtgtggaataaggagcgatttttgtgagaaagttattccgaactttttagtattgaaatgtgtttgtggttcaatcagtatatttgattatgtaaaggcatttcataaaaatagtcttaagaatttgtaagctaaccgtgtttaggaatttttagttaactgtgcttctataaaagatgaatctaattaggtcctggattttagttttttagtttaaatattaaggacatttcagaaaaatagtcctaagaatttgtaagctaattttgttaactgtgcttctattaaagatgcatctaattaggtcctggattttagttttttagtttaaatattaaggacatgtcagaaaaatagtcctatgaatctgtaagctaattttacttaactattcttctatttaagatgcatctaattaggtcctggattttagtttttagttttttaagtttaaggatatgtcagaaaaatagtcctatgaatctgtaagctaattttaattaactattcttctatttaagatgcatctacttaggtcctggattttagttttttagtttaaatattaaggctgtttcagaaaaataatccaaattttttatgttctttttccttctttgtagtgtgctaattgaaggagatcatattttcgagtttgatgtttggcataattcgatgaactattggaaaggagattttcagtataaggaaacaataaaaagtttcttgtcgaacatgcaatggaagaagttgagggatggtgtttttggaaatacttttcaattacaaggtgtgaagttctgtggtaaacttattcattgtgtgttgctttcagaaattataagcaataacccaaattcaatgacatttaaggtttttgatcatgaagtgaagtttacacgtgacgttccatataattactaggttgaaatgttcttcttcagtgaacttcaaagttttgagtgaaagagagaataggcattcgaaagtctacttccctagaaaggatagaatcgagttaggcgatttgtggcattttattactagtcatccacatggtacagatgcatcatttgcaggcagccataacgatgcggtgaagttggcaataatttattttgtcgaatctgtgttgatggggaagcgcaagaatcagaatgtgtctgagctggtaatgaaaaccgtagatggcgatgaactctgctcttctttcaattggggatctctttgttatgaaaaattagtaaaatcattgaagagttgcttgaagcccaaacaaaatacttcagacaatgagaatgagaaagataaagacaagaacaattatactatacttggcttccctttcgccttctgtatttggattatagaagtattcccatttttcaggaaaatcaatttgtgaactcatagaatgtgggttcccttggatgttatgttattcagatatgaaatctccacattatgacaccctatgtaaaaaatacttccatagaaaatgtaagttaatctgattacttgcttctttttttttttgtttatgtgttatagttctgaaaacttatccttttttatcttatataataggtgtataagttgatcgaggtggcaccaattctttcttgtgaagaagatgcggagcacattagtgtgcatgagccattgtctcaagatcaaagtctaatgccttccacacaatttgatgaagtcttgcttaaggaaattgttaatgtaggttttatgtctttgaatagcattagttttttatttgctaatttttgcttaagagacttttttatttttatgatttttgattcagagattatcggagaagttcaaaaaggatatgcaggcagaagttactagagtaaatcaaaaatagctatatcaggaaaaaagattcaaaatgacatcaaggtaatatcattaatttctgtgcttgtaactctaagtaaaggacacgatgtccttaatttttgagcttgtaactctaagttcaggactacatgtccttaacttttgaacttggaactcgaagtcctggactacatgtccttaatttttcttcttgtaactgtaagttaaggtctacctgtccttaatttttgtgcttttaactctaagttaaggaccaagtgtccttaatttgtgagcttgtaacttgaattttaggactacatgtccttaactttttaacttgtaactttaagttcaggactacatgtccttattttttgaacttggagctctaagttcaggactacatgtccttaactttcgaacttggaactcgaagtacatgactacttgtccttaaattctgtgcttgtaactctaagttaaggactacctgtccttaatttatgtgcttgtaactctaagtcaagacttactgtccttaactttttaacttgtaactctaagttcaggactatatgtccttaacttttgaacttggaactctaagttcaagactacctgtcctttatttatgttcttgtaactctaagttaaggattacctgtccttaatttctgtacttgtaactctaagttaaagattacatgtccttaatttctgtgcttgtaactctaagttcaggacttactgtcctcaactttttaacttgtaactctaagttcaggactacatgtccttaaaacttggaactctaaattctggactacatgtcctttatttatgtgcttgtaactctaagttaaggaacacttatccttaatttgtgtgcttgtacctctatgctaacattctgattcttattttaaatactatctcacatgatttaaagaaaaacctaggatcaaagattgatactttgttgacgcttcttgtcaaacctcatgaaaggatcatagagagagaaccttgtgttccaattagcaaagatgcaactgatgatcaatgtgatgatacagaacctagtgttcaaattagcaaagacgtagctgatgatcaatgtgatgatacaaatgggcatgtagaagatcattatgaaagcgattatagagatgcgcatctagaagatgaaactgatattggcattgaaattgggattgatagagtggaagttcaagatggagtggaatgtcaagattaggaaaatctaaaatagataagagtaacagaaataatttgtaaatatggagtgcaatctcaggatttagaaagtccattgggaacaagtataagtgagattgtatgcaaatgtattgaaggaatatatgatctatctacacctctctcacttaaagagaaatttggaaataaaaatgatactaatcaaggttagatggaattttcatgatatgttgaatgttagttttagtaaacgattagtaacaagtattaattataaatgttacagaatcttttgaagctgcaaggaaagaagacggagtggactatcaagagagaagtggaggacaatctcaaaacttagaaaatacccaaggaacaagcataagtgagattatttgcaaatgtagaaggaactataatctctctacacctctctcttatagataatattgaaagccaagaaaatgctagtcaagataatgatttaactggcatgatcttgacagttgcaaaaggtttgacagactttttcttaatcttatacatgtttgttttaatcaaagattagtaacaagtactaattatgttagctcttgtaaatattttgcagaatcttgtgaacttgcaatcgaagaacatggagaaaagttgcaagataaagaaaatgcacagttgcaagataaagaaaatgcaaccaatatgtcagctccattgtctgttgaagaaatacaagaaggcaacatggccaacataggtattgattgtgtccttaatattgtattcataattcaaatttccaggacatttcaaaaattatgtccttagtttttgtctcttcgtttgacaatttgtcgtagaattgacgacttgcagcaaactaatgtataggtagtgttgtttgcagagcaaaacaaagatgagtcattaaccaatatactaggaaaaggaagagagatagtattggttttgatggtccatcatttgctattcttactcctactcctctaactacacaaatgagcattgatgaggatttgtctatggagattgaaggaaatgttaaagaagatcttggtcgagggaaggaataagaagcttagttggcaattttaatctccttttgaacagaaaagaaaaacaggaacatcgatggcgcaaaatgaaaatactcccaagtatacgggcaggataaaaacaaaatatactcgtagatgtattttttattatgccaaagatgatgaaaacttattgaagaaactcattgggtggttgggcaaggagaaaaggaaaggttgcaaaaaagcgtaagtccctaaatgtattcattatttcttaattgtttacattcgtgtactgaacttgtaattttaaatttaggactaagtgtattgagctcgcaagtcctaaagttaagtgtccttaacttttaagattgcaagtctaagttcaggaccaagtgtcttaacttttgaacttggaactcgaagttcaagaccaagtgtccttaacttttgaaattgtaaatgtaagttcaagaccaagtgtccttaacttttgaacttgtaactgtaagttcatgacctattgtccttaacttttgcgcttgtcagtctaaattcaggactaattgtccttaaattttgaacttggaactcgaagttcaggaccaagtgtccttaactttagaacttggaacttgaagttcggaaccaaatgtccttaacttttgaacttgtaactgtaagttcaggaccaagtgtccttaacttttgaacttgtaactgtaagtttaggaccaagtgtccttaacttttgagcttgtaagtctaagtttaggatcaagtgtctttaacttttgaacttgtaactgtaagttgaggaccaagtgtccttaacttttgagtttgtaattgtaagttcaggaccaagtgtccttaacttttgaacttgtaattgtaagttcaagactagctgtccttaattaggaattgaggactaacttctaactttgatattctcaaaattttcaggggacaaactgatatatatatgctgacgataatggtgtgagaaagaatccatataaattgtaccatcaaaaaatcagtagcaaaatattcttccttgagctttcagatagtagctttatacttggtgatacggtttgataattcacaaggcatttttttctttattcttaatttatcattttttaattatttatgtctgatggattttttttcttttttgcctttttctgaagcatattgacattgccctgtattatttgagaaagaattaatgctaccaccctggcgcccatcctttttgttgcacaactacagatatattttctgataactatatgctacttgcgtataaggatttaaatgaagatgctacaaatgagttttggtgtagtataatcaattggttctgataccatatgtgtggggtaacaatcgtaaatgtggaaattgcttggacagaggttgacgaaatcttttttccatgtcggcttccttcagaagataatgatgttgtgacacattttcttttgggggtattggaattgaatgagagaaagattgatttgtacgattccatatatagttagccatatgagcaaggaatgaatcacattgaaatgtatgcacacatgatcccccacttgctaaagttctcacagttcgagaaaaatcacgtcttttggaaatgcattcaacaaatttgatattcagtggcaaagatcaccacaccaaactggatcatacatgttgtcatttgctatataatttatatgtactttagatttattttattaaagatatttttcagttgactccatatcttacatttttcttaggactgattgtggtacattcctaatcaagtatgtggagttgttgatgatgaagcgaatgcgagaaattacaacctaaagacataacaaaactttagaaaagaacttgcagcaaatctttgggcacacggagagtgaaaaagaaattctagttatgatacaccaccagaaaatgttagcgacgactatgatagtgaaaataaaacttcctgcccaaagaagctatagtttagcggtaaagaaagtcagttgtagttgaatttggtataaaattgttgtaaagaatccatatgaattctgaaatatcctgtaaattgttcacaaagcacttttattttgtttgtatagcataattttttggtcgcatctataccaaattacagtttcatgagtaatatgaaggcatcatgttattaattctttctttctgttaattattgatttgtccatttgcaattcctaaattaagtgtattgagcttgtaagtctaagttgaggacctaatgtccttaacttttgaacttgtaactttaagttcaagactacctgtccttaacttttgaacttgtaactgtaagttcaggactacctgtccttaacttttgaacttgtaactgtaagttcaggactacctctccttaatttttgaatttgcaactctaactccaggaccaactatccttaatttttgaactttcattctaagttcaagaccaattgtccttaactttttagcttgttaatctaagttaaggaccaatgtccttaacttttgaatttgtaactgtaagttcaggaccaagtgtccttaacttttgaacttgtaactgtaagttcaggacctattgtccttaacttttgagcttgttagcctaagttcaggactaattgtccttaatttttaaacttggaacttgaagttcaggaccaagtgtcctttaaattatgagcttgtaagtctaagttcaggactaagtgtccttaacttttgaacttgtaattgtaacttcaggtctatttttctgaaaatgtcctgaacttctggaaatctagacaataatccgagatttccagaagttaaggaaattttagaaatttatgtccttaatattagattcataattcaaattttcaggacttttagaaatctatgtccttaagctttacttgtaccaatctgattttaaaaataaagatgtagcaagctgcatgcgtcaaattctataaaaaaaaggactttctttttacttacaacaagagtaaaatcccataaacaataattggtccgacaaaggtaaattgaactcccaaaaaaagaaaaagaaataaagagcacgtaagcacaaagaaactttgaaaattcaggacatcttttatataaagatatatagtaattatgtatagcacatacacacatatatattatataataatataattatatatattaaccaactattattttgggagggttatacattcttgatagctgcaattgcatgtatacatggtaatttatcaagtagaaactgaaaacaatcacatgttcttttgtttaagtccaccaagaaagtaattccttcttcctcaactctagaacgccatgaatcaacagggaagaccttcaatgttgaaaaattataagttagtacattatgttaaattattagaaaaataataagctacacaaagaacaaataatacttacatttaaagtaaaagctaaatctatctttttcttcaattcctcttctatccagtcagaaacgtcataaaaagttccttctgcttcatttcttctttcataaaaccaacgttgtagcttcacttggatgaaatccatcattcttaatgtaggaagctcccttgcttctaatagcacataattcattgactcaactatgtttgttgtgagcatgtcatatcttcgttgtggactacaagaacgtgcccacctttccggtggttcttccatcaagtagtcaaaagtcttcttatcaacttttgcaatatctgacatgtatagatcaaattctttacacacgtatactcttgcagcactttggaaaagtttaatgacctcacttttcactttccttcgctttagattctgctccaaatgatagatacaaatctcatggtggctttcaggttatacatttgcaatgccacgtgcaatagattgatgcttgtttgataaaaaaaattaaattgtcacggctcccaattgcattgcgaagctcactaaagtaccacttataggaattgttattttcagattctgcaattcaaaatgctagtgggaatatttggttatttgcatcctttgaaactgaaatcattaaaacaacacgaaattttaacttcaaaaaagttgcatcaacagcaatcattggtctacaatgattccaaccaactattgatgatccatatgcataaaacatataaagaaacctgaatatacagtataatagaaggttaaaaatacaggacaccaaattaaggacaggtagtccttaacttagagttacaagttaaaaagtaaaagacaggtagtccagaacttagagttacaagcacaaaaattaaggacaggtagtccttaacttagagttccaagttcagaaattaaggagaggtagtcctgaacttagagttacacgcacaaaattcaaggacatgtaatcctgaacttagagctccaagttcaaaaaataaggacatgtagtcctgaacttagagttccaagttcaaaaaataaggacatgtagtcctgaacttagagttacaagttaaaaagttaaggacatgtactcctaaagttcaagttacaagctcacaaattaaggacacttggtccttaacttagagttacaagcacagaaattaaggacaaacagtccatagcttagagttagaagaacataaattaaggacaagtagtcctgaacttcaagttccaagttcaaaagttaaggacaccatgtccttaatttttgagtttgtaactctaagttaaggacaccatgtccttaactttttcactgcacacgtcaaagttaaggacaccatgtccttaactttctcaccgcacatatcaaatttaaggacaccatgtcctaaagttgctaaaatagacaataaaactctttttgattgtttacttgttgtcctcgtctatctttatgttagtatatgttctcgggtttttacttttcatcatatacaagtatgaagacaataattcataattctcttcaggagttcctcttattaaagctgaagcacgttgaatagcacgccatgccttgtgataaccaatgtctagtccttgcaatttttgcatttctgccatgacaaatgctggtctaacttcaaactttggggctcgaagattgtcaataatataaccactaatcaactttgaagttgcatgcctttgttcaactttcatagtgttaactgagcagtcatgatttttctcaatctttactatcttgaatagtgttgaatctttaattctgaaagcatgcacacactaccacaccattatcattgcatttcagcgaatatcttattgagcttgatgtaacaaccttgaattcaaaatgtcctttaattgctatattcgaaaaacagttaattatactcttctttttgtcaaatattgacccacttttatttcatccaacgaagcattttctcttaatatcatagttggggattctttttgtttcgaatttgagcttcgtttagttagttgagtagaggttttttcagcaacttcttctattaccggtgcactctctaagacttgaatacccaagcttgttcattgtcaatctctataatgctttgtccttccacttgaatagaatcaaatgtttgaagcaccttttcagttattggttgagcttcaaccacatctattttcattatctgttcacatttgtcttgattgtcatattgagtttctctattgacatgttcaaaggtgcttgtaaaaccaaaaactctttccgaaacatcaacaatgaaacgatagcccttgaagagtgaatgactttttagtaactctatacatgtgtgaagatctaaatctttggatacaagcttcccttgcttgttcccaggttgatatcaaaccatatcattgcttcaaacttgtctctatccaatttaataacttcaaagacctgtttaatgaaatcttcaaatcaaattgcttcgggtactagaacaagctttgttttgatgatcaagatacttatgttctacagtccatctaccattaaaagcaactataatacatattgtttccatcctgcaagtcaagaaaataaaaaattcaggacatatttatacatcaatcgtgaagtttaggacacaatgcctaaactttatcaatacaagttgcaaaacacatgacactatgtccctaatatttagaacagtcatgaagttaaagtactctatgtcatgaatatttacacagtagtcatgaagttaaggacactatatccttaatatttagaataacagcaaacaagttaaagacatcgtgtccttaactatttcaatacaatttgcaaatacaggacactatacccttaatatttagaacaacaaccaaaagttaaggacatcgtgtccttaactttttcaatacaatttgtaaatacaggacactatgcccttaacttttgaacaacagcaaaaaagttaaggacatcgtgtcctttactttttaatacaatttgtaaatacaggacactatgttccttaatttctaaacaacagtcatgttaaggcaccaaatccttaacattatgtcctcatcatttatagaataatcacagaattacggacgcgatgtcctttacgttatcaatctagaaaagggaaaaaaatcaaattcctagcatcttattcttcagtaatgaaataaaaatccatacaaacacacaaaagcataaaagatatctcaaacattagaacttactataattttatggtgaattttggacgagaaagttgaattctctagtttgaaattggaagagaagcttctgcaattttggatgatcacagcctctgtaagttagttacgtaagtttgcgctgttgctgctgatcattaataaggagcataggtataagccaaatccttataacagaagggtatattcagggcgggtaaaagcttattaaagcagtggttaaagactaaagacatttaaaacagtggcttaaaagtaaagacatgtattattaatggctatctgtgcatatcgcccatagattcacgaatttgtccttcgggctacactagtccaaaaacgtgcatatcatgtgatttgtgacttataaagctatccacttttctcttcctttctgatatgggattcgccctccatcattggcatcacattcacccccctagttgggacacaggcagtgtcctcaccgaagtttgctccaccatcgtactgcgggagattcagctttgataccatatttgtcaagatccagttagcctatcgtatgtattgtttgctttggctccacaaaccacacagatttttcccttgggctatttcattatggagtccaaaagtacgtaccatgtgaacttgtattgtgccttataaagtttttcacttttctatcctgttcatatgtgagattcgcctaagataacatgcgtaactctttttaaaaacttgtcagcttagaagccttccagtcctactcgatccgcccttgtcggcctgcccaccatcacaggagatgttgactgcaggttatcatcaatcattatatatcgagtttcgaactatgtgaccgttgggaatttaatttctttgtagatatatatgcagcaacacaatgtggtactgactagtataaaggaagaccatgtaggagcagcgcaatatggtactagcaaactgtggaatttgatttcattgagagggatttagtattatgttttcttttatttctcattcggtattcgatatccacaatggggctcgattaatccagatttgctccagaaagtcccatattgaagggtaaatgttccctaacaaaggtgactccatacccagatctcgaactcgagatctctggttaaagatgaaggagtacttaccactccaccataatccttgttgatgaatctagtattatatttacatcaacctatttaataaaatttttttgttgttattgttatcgtcattttgagttacaactcaaacatttatattcatataatgtatttcaattttatagttcctaaatacaattcgaattatgttaaatgaaaaaatatcatttgatgtcaaatattctttagcactgaccaaggtcgaagttagaatatcgagaacgggttcgatatactcatatttaattttttttatctttttattttcatttaccataaaaagagtgttaataaactactcatacctgatggttttgttagtcattattatcaattcctattcctactaattctattttcctttttctgctaatttatgtcattttcttgttctctcttaatattttgtgtttttctttaaatttttttatatgtcgtgattcacattctcaatcaatcacttgaatagaatgagtgctatatattttaaaggaaaaataaattttattctgcaacaaattgcaaaacgttctaaatatataaattatttaggcaacgatcttctagtccacgactgaagctatttatatctggtagccacaaaaatatataaaatttatatattttttgcatataacatactaaaatgcatatacaaaaaatatcgaaaaaaatattttttccgctatttattttgagagtggttatactagggtgtttgttggtcggtacgatacggtatttagacatttcagtttggtattttcagtattcagtttcttcaaatgctataaccaatactgtacctaattaaattcggtatgttcgggttttctcctttcggttttggtttattaggttcggtaacttcagtttattcgatttgaatactaactagtgcgtcgagtcatagactataatattattaattaaagcactaaaaaatataaaactaaaaatatttgttgacaaaagttttgtccaaaactagcaaatatcaacctagagagagaaaatggtacataaagaaataaatttggtcattagaaatgtcttgttacttgcttagagttagttgatgaacttataaaataaaagaaagtaaaattttaaattttatatttattttataattaataatacgtgtattatgcaatataatatgattatatatatttcagtacagtatcggaattttgatattttatttttaaaaccaaatgccatacttaataccaaattatttttaaaatttaaatcaaatatcatgccaagtaccaaaatatcaaatatcaaataccaaaattttcgatttcagtacagtaattcggtatttatcaattatgcatagctaggttatacggtggtaacggctaaatgatcaaataaataaattcttgagagagaaaaaaaaggaaaaagaaaaaggatgttgacacgtcttatccacgtgtcattccttaataggtaaacactacgtttgttacaaagtcgctacaagtagcgcgtggtcaacaatctctctttctcttttactctttctttatgtgagtaagaaacccaaaaaaatggtgaggaagagcagaatggggtgtggctattacgtcgtcgttttggtgttcttgttcttcggagctacgagagtgagatcagattcatcagatcacaaatacaaaaatggagagaagtccctttatatgcaaacaaagttggcccttttcataaccctaggtaataacccttttaccccttctcatttttttccttaaatttttgttttttatgagtttttgatttctgggtataattctagattttgttttgggcaaaaatgttgctgaaatttgctgaattttggctctattgatgagtttgtttaatgtatattagtgggtcaccttaatttttgagatttgtgagcttttttgggttgttgtttatatcttttatgtgttgaatatctgggtagaaatcaagattttgttttgggggaaacgttgctgggatttgctgaattttggctgtattgctgagtttgctcaacttttcaccttagtttttgagatttttgagctttctttggttgtagtttacattttatacgcgttggatatctgggtaaaagttaaaggaatttttttgggtagtattgggatgaatttttgggaaatctggcagggattagctgaattttggcagtaattttgatctgtttcaatatatgtctgtcggcctctttgttttctgagaattttgagcttttctttttctttttggttgtagtttacattttgtacatgttgaatttctaaaaaatgtagtcttggaatgaatttttggggggaaatgttgctgggatttgctgaagtgtagctgcatcgctgagtttgctcactgtatattagtgggtcacctaagtttctggtaattgggagctttgtcgagcagtagtttatatcttgtgcatgttgaatatcagggtaaaatttaagatcttgttttaggcagtgttataatgaaaaggggaaatcttgttaggatttgctgaattttggcagtaatgttgaattgcttcaatagacatttgatggtcaccttggtttttaataatggtgagcttttctttcttttgggtgtagtttacattttgtgcgtgctgaacttctgaaaagaaaattaattttggaatgatttctgggggaacttatatgggattgctgaagttggacattaatttcaatgtatgttaatgagtctacttggtatttgagaattttgaatcttttatctgagaatttagctgtacatgtacaactatggagaaagacattgtttttaatatagtcaatgttgtaagagcactaccaaaaagagtggagcaaagggcttgtcttttatgattttcgtgtttggataagagaagagttcagccatgtgtacggcagtgttttaaaaaaaagatatttttcttgttttcgactcttcatgttaacaaaaagttgtgtcttggcacattaagtatcatttgctgttgtgtaggaaatattctcgatatgatcggacgaaattattggtttttaataaagccaaacaattgtagaacaaggaaagaaagcttcataagagtgagaaaaaccagacctgccttccatagagctagtttgaccctcacttgatctctatgcaaaaagtgattgtaggcactccgctttagatattgaaagatatgtttcactaagctaccacatttgacaaattgtatgtccacttacttgtttttgaaaattttgttcttgtgagtcacctagatttgatgattatcttggcagctagcatacttctattttaatgcacataggaaatgtaaagttaatactacattttcctttgatgagcatgttagtatcaacaaatttcccaacatttgtttgaagcatagttctaaaagggcatacctgtactcacaaaggttcttctcaaggtctgcatgtatacaaacacacacattcaaacacttttttttggtaagtaaacttatcttattaataatgcgccaatatggtgtcaaaagcatgtacaatgtggatatacagagtgtacttactcctttaaaaaactgcacaactacctagtagaaatgctagaaaatttctcactttccctatggttaatacctagctagggggtcatcaatgttggaggaggaactaacccccactccacgtctccggatatggagacaaaaacattcaacatgtgctcagtgcctccctcagaagttcttgtttacacacttccttcaccaaaattaggcttcttctagtcattttcagctctttgtatcaatttcaccagtgacctagaacagtcgttcggcgacttctctctgatttctccgtgaagaatttgttttctgcatctttgttctcaaattgcttctaatcttatttgcttgttatttaacctaattaaaaccactctcttaagcttttcaatttttggtgtgtgagatggactttggttttgtctctatctgctttgatgttctcattagccactccttttccttctgctgatcaaaaatagaaaaaatatttctgattgtactaagctagcacatgccacattttccgttctcctccgagatctcatgtttgtactgtcaattgcagtaaacatatcgctactttgatcttccattttgttctccaggtcaggttcatttctctgccctctcttgctctaatgtctttggtcctttttatcttttcttattgaatatatatatatttttgtgacgattggaacatatgcttattcatgttcgttcattaggtcatgtgaaagataaaacagaagctctcggtgaggtgttgaatggagatcgtttagtcactgctccgtacaagcttgactttctaagtgatcgagaaactgaagtagtttgcaagaagtcattgtcaaaagaagaagttgcaagattccgtgacgctgttgcgaaggattactatttccagatgttctatgatgacctgcccatttggggtttcattggtaaggtagataaggagggaaaatctgaccccagcgagtacaaatactacctttttaaacatcttcattttgacatccatttcaacaacgatcgcgtgattgaagttaatgcacgaactgaccccaatgctctagtcgacataactgaagataaggaagttgatgtagacttcatgtactctgtcaaatggaaggaaacagatattccttttgagaaaaggatggaaaagtactcacagacttcagctttgccacatcatttggagatccactggttctctatcattaattcttgtgtcacagttctgctcttaaccggtttccttgccacattctgatgcgagtccttaaaaatgactttgtcaagtaagtaactaaaatttttggggtaggatactcatttatcgaggagcttgtactcttgtatgatatgtcctattttggttaaagatacgcccatgacgaggaaacagctgatgaccaagaagaaactgggtggaaatacattcacggcgacgtgtttaggtacccaaagcggaactcactttttgcagcagccctggttctggcacacagttgtttccctgtaagtgtgcatgccaataaaatgggtttagttggttctagatttatttagctcgtgataaatttcttttctcaccatctctttttcccaggacaattttctattcatacttgcgcttgttggtgtgttttaccctacaccgaggagtcttttcacagctttggttttatttatgctcttacatcaggaattgcaggctatactgcagcatcattctattgccaacttgaaggaaaaattgggtaagaaagtatgaagcatatttttattgttgcaaagtagccaaaatttcctactagtgcatctcttattgtgtccacttagtttccttatttcatcattctcttctagttagtgaagatctcttggttttgacagggattagtcgtgataggattttaaagtaaactttctccgcgaatttagtttcaaacagcatattctgcagtacaaggtcttgttttttttttttgggggggggggggatggttgagctatatcgcaacatagaaagccttggatatgcatccgatgattaaagaccaaacatacttgtgttcctggatatctcttccttggttgctacattgaaaagggctataggttctacttgtaaaacccaacactgaagcatattgctatggttttcagtcttttgaacaatagcttaagtaactcttgtttgcccctatagcaataatctttttggcaacacacctagcatatttcacttctattcggtatgtttgatggaagactgcattagtttcacttttaaggtggattatggaaggtgggttgataggaggaggagaatatgtgtcttgactggtgggtgggagagagggaagccaaaatttatgttactaatattatcacatttactactaacatgcaaatctgcgtcaaaaggctatttataaacactcttatttaagtgtacgaacatggccaaaccttgatccaattggttgatatcgcctatatgaaattttgctttgattgtattatgttcattcctaagtttccacgaattttgtgagattgacagtcttttgagacaacttcctcttttaatttacctcagtccattttactggcttttccttgccgttcctctctctctctctatctttagtttctcttctttcctatttgttgtttacaacttattatccttgaaaccaaatacagtggtttccaagaattaatgtagtggtcgccgatttcacagattaaaaattactggagattgttcggtttgtttcgtgcagaaagtaggaaactatgtactgatctcaaattcaatttcctttttacaggtaaggaatttgttgttgacagggggtctcttctgtggaccactgtttctcacgttctgcttccttaatactgttgcaattgcttatcatgcaactgcagcacttccattcggtaccatcgttgtcattttcctcatatgggcccttgtgacatcaccactgcttgtcttgggaggaatcgcaggaaagaatagcaaggcagaatttcaagctccatgccgaacaacgaaatatccaagagagataccgcaattaccctggtatcgtggagctcttcctcagatggcaatggctgggttcttgcctttcagcgccatctacattgagctctactacatatttgccagcgtgtgggtcataggtttacaccatttacagtatcttattcatagttttcatcattctgatcattgtcactgcatttattacggtggctttgacgtacttccaacttgctgcagaagaccatgaatggtggtggaggtaagttattaatagtacttaattgaccaaatccttttcaaacagttgaaggatgcaaaaatgaatgattactagccatttctgtacttcctttggtgaatgcatcatgtcatggaactccgaaatgttccctgtgcatgtcatgttaatacgacattaataatatgctgcatgatcattccaagtatttattagtgagtatttaaataggttagcatcattgtaacttcatccatctccttctttgtccttttattttgggggattgggaagccggcttgatttttccctatttggttcggcctttgtctctatttgattctttggtgagtgctgatttagatctcttatattagttggggtacttgaaatttcaattttcaattttatcatcttattctttatttttaacgtatacatttagacacaattttttttggaaatacgtgtgctttgtcgggctctcacttatatattgatcttgtaggtctttcctttgtggtggatcaactggtctgttcatctatggatactgcctgtattactattatgcccgatcagacatgtcaggcttcatgcaaacctcattcttctttggttacatggcttgcatatgctacgccttctttctcatgctcggaactgttggtttccgagcagctttgtttttcgtccgccatatataccgttcaatcaagtgcgagtaagatgcagttccacattgtcttggttcaactggtaaattttcattttattacttttgactttctttattaggaggaagccagtagacctgtgttgctcagatcctgcaaaaatatcagcgcaccagtgtccgatccttcaaaaatagtgcattccttgtaggatctgataggggtacaacaataatagcgacccagtatagtcacacaagtggagtctggagagcgtagtgtgtacgcagaccttacctctacccgatggggtagaaatgttgtttccgatagaccctcggctcaaggagacgaaaagacaaaaagagacgatatatcaaaaccatcgtgcaaataataacaacacaagaaacagtgaatagatgaaagacagaaataatgaccagtaaataaggcccgacactatgaaaacggaagagtagtgtaaacaatactgaccactagccgtctaagactaaatcctatctagccctcatactggtagacatatgctcaactacctcctaatcacaaccttaatgctctacctcacagttcctatcgagtgtcatgtcctcggagaactgaagtctcgccatatccgcctggtacctctccccaatactttttaggccgctcctacctctcctcgtacccaccaacaccaaccactcgcacctccttaccggggcatccaagtaggatctgataggggtgcagcgatatacttttggagaatccgagcaatataacttgtcgactatagattacatatatttttaattggctatactacgaatgtacatggagcaggagcttgtgtttttggtgtaaaaatggtcaacatgcttggagaaatgcagcacattcccagatatacaaagtgttaggtccatttagaattggtgtggagcaaaacaaagcagaagatatgttaaagaggatgctcaaatcagttttcaggtggcagctttatgttgaacagtggttttaattgtttttaggaactctatttgtaacaatgagtctattagttagctcagcttaattttcctagttttaacctttttgatatatataaaatatgggtctgttacactgctattgtagactagcttttaactcttctagtagttttttactagaagagaaaccttggattaacggtaaagttgtctcgtatgagctagttaacaggttcgagccgtgaaaacagttctaaatggttgcattatcaaataggttataggcaacaaaaaaaccagagaacttgctcaataataaaacaccactagaagggaaaccttggattaacgataaagttgtctctgctagttaacggctcaatttgaattaactccccaaattaaatattcatctctattcgatttgggttgggggtggggtagggtggggtagggtggggtgtatttaccctagactgagtaccaaagagtgttgtagcttttttgattgataaaagattactttatgtgattaaactttgtgcctgtactaaagacttaggtcgtttggtatgcggtataaggtgggcaagatgtaggattaagtaaataaatttatacctttcaccaaacaaggtataaatttaatcccagatttaattcaggatatcccgtgttattccaccttatcttatcaaatgtgagattattttatcccaatctctcatgtgatataaattagtcttgtaatattataatcccaggataatttagtccgcgtaccaaacaaccctttaggggtcgtttggttagaatacatgtagaatcataaaatatttcataatctataactattaagtaattaatatattgtacaacttaaatacggtagcatatttaatagaatcaattgttccctaaaaatactccatcgcaatccctataaataaggaaactaaataggaaaaattatccattgcctttttatttgtactccttctccaccatattctcaacaaacaatacatttttttatcaaattttccttctctagtcgtaggagaaataatctttaaataaaaattatcaaaaaagggaataaaatacatcatagtcaatatatagcatgtaaactttaatactaaaataattcaatgtgaactaacgtgcaattatataacctagatatgatgtattgtatattatatataccaagtgtcatataagtttatattatataatgtattgtatacttataccaatgtcatataagtttatatatatcatatattgtataagatatttattagtagtaaatagggttgtgcatggatcagattgaatcagatttagcatatttcggattcggatttcggattctgaaaagggcaatccgaatccgatccgaattaacattggatcggatgggattttaaactttggatcggatattttttcggattgtcggattggattgtcacttaattatcctatgctggattttatcctatactatatactcactgtatattttaccaatttttaacaaaaaagaaagtctccttctttggagaaggagaaggacatttggagttcaaagttttgaactgaagagactcagagaggcggagaaggagaagtggagatagaacatcgatataacttaggggacgggttgtctaaaaaatgactatgctttaaccctaaaattttagtgtagtatttatataggccctataatttcggatttcggatcggattaaaactatatcaatccgaaaatccgaaaatttttaaaatataatccgcatccattttgaaattcgaaatccaaaaattcgaaatagagtggatcggatcggatttcggatatccgatccaaatgcacaggcctagtaataaatatcagatttttttgctaaatgtatgaataagatgaactaaagtgatattgtacaatgaaggtatgttgtattgtatacttatatacattttcatataagtttatactataaaaatatttatcagctatatttattattagtatacatgagatatatattttaataacggagaagaggcttgggatattgggatgtactcgagtttacacagaccttatacttcattcaagaaggcacaaagaggctgttttcggttgatccttggctcagtgaaaaaaaaaggaagggcaacaacaaacacaccaatcagaaaactaaagcgaaaatacaatactaacagtacatactataatcagaaagccgaaacaaaaatacaaaactacacaaaagaacactaagtcatgtagtagagctacatttaaacaaatatttatattgttctaaagatgacaaatctcctccttcaaatattaactcattaaatactaactaatctaagaattttcaattaagagaaagagtacaagaaactttaaaaacaaaaccacctaacgatgtggtgcagcggtctcgagttcgagctttgggtatggaaaaattctttgtagagagcgtgaaaccgcttataatcggactccaacgtaaatacctgacaccgaacgagaaaccaactcaaaaaaattttaagctccaccagtgatactaccattaaagatctcaatagtgtcccttgagaaacattatgccatctaaatgaacgatcatcatccattacattttgcttataaataaaaaaatacccttcttttggaagatctaattccaatttttggttcaatatttgtagctcttttctcaagtgtcccacattgtctgacggattaatttccataggaaatttcttcgtaccacatttggataaaaccaaattcttattttcttcgatccgtttatattatttcctgatgatgatcctgaagaagttgttgtcgtagacgccgcgatataattaggtctgattatactaacatcaatttctgaattatcagaaagtccataatctagtagactttgatgatcaatcaattcaattccattagcatacattactaatttactcacatgtacaccttccatatcgtgaattctctcttttacccttctaacgctatccgtaacgttcatttctagggcaatccctagttttggcgacgttggcatcttgacgaggagttggattttcttcgttggagtcggagacgactgttctgccttgatgatattaatgttcttgtccgattcggatttgaattcggattctacgacgagttgaatatgagaattattgaggatatcggaataatgaacgtttatatgatcgtctaaaacgttacctttgaaaattaaggtttgttttggaacaggaatgccttgatatttttggattttttctttgatctctaagattgaatcaaagtagccaacttcaattgaaaatggccttccttttgttggttgaaagaataaatccatttacacaatcttttaattttcagtgtctttctgagtttagtcaaaaataaaatctcaaaaggttaaattaataaaaagagataaaaggaacattcaagaagatatgatttttgcagctaaatctgaggacagttacaacaaaatccgatattttcacattctttaaattcaatttatttttacaatttttacaaaaggaaaaaaaaaataatttccttacttttttgactagataattgtgatttatatactaataaaacattcagcattttaagattgttatttattagatacaaaatggacaagttgataaataaaactataaatgcaggtaaatcttacatttacgtgagattataggaaaataattaattcatttttgttatttgaaattttataggatatgaataatcctctatatttgctgcgccttatttgacgctatttcactttaatacttaatatttgattctctaaggcaaattaaataagaattttctagactagatattttttaaatctaattttattcctttaccaacatacaaatatttgaccaaactaaaaagcttctgccaaatgtgcttaattagccacatgtcacaaggatcaaagtataaattcgtcaaaacttgagggactaagcgtaaatttcccaatatagaaaggacccttaacaataaatattttaatataattattattaatcggcttgtttggatagttgttacttattgtattgtatcgtgtcacttcaaatataatgattgttttgattgttacttaaattttattgtattgtattgttaaagtcattgttacgtaacgatgaaaagtgccactttatggaacgacagatttggtgtagtggcatcgttaccattttttctctcatcttgccctttcttattattaaataattatattttattctttaccctacttttttaaataataattctactccgaatcatattttttcttagaatattgcaagtttattcttcatattgttggtgtgtgatatcgtaaaatgacgacaaacgatataatttatctgaacattatattcatcaaacaatacaatacaatacaatacaatacaatacaatacaatatattataaaacgttgtttggttcgaaatagaagttgataacacaaaaaagaaattagcacccccacccaccccagcaaactggagaatctaatacctcttttggaatccatctgagttcttcccttgtgaagtatttaccttttaatttcttatttggtattagatatttgtattggggttcgattaaatttgaatttatgccgagaaattcgatattaaagaataaagcatccatagcaaagacgattcgatactcaggctcgaatctatacaggtgaaatttaaaaatagccagatttacaagtaatgattgaaaaatagcacaatttaaaaagaacatcgaaatttagccacttttcacgtaaagataaatatgaatgaaaacactgttcaaaatctgaaaaatattacaacatagtatactggagttcaaattttttacagtgaacctccaggtaatatactggagctccagcataatatactggttcaacataatatgctggaaattcataaacaggatctccaatctccagtatattatgctggaactttctgtgtgctggagttccagcataaatatgctggaagttcatacacaagtgcaccaatctccagtatattatgctggaactttgtgtgttcagcaaaataatggctatttttcaatgatcttgcaaatgctgactattttttaattactactccgaaaactggctagaccgtgatattccacaatctttattagagataggcccctaaagtattttattttttaaaacatggccacatgttaatagttcattaacctaaagtatgataataaaagcaaaagcatgtgaatataaaaaagcaagcactaccataacttgatggaagaatgtatacctaattattatttaataaaataaattaagtattttgccttacattaacttatcttcatgaaagcaaaacctgtattaactcagtattataagttttggattagtaccatctattaaaaatttaaagaattaacttaaaaaataaattatatttagtgggtgtgcttttctaagtggtggtcaacaaatgagaacgaatacgaaattaataacttaatcagttttagtacatctaagtaggtgcttaattgaagtttagtacataaataaaagaattcgttcgattttaagattttttttttaaatctcacgaaaagcaagctcaacgagataatatttttaattatgtttcgcatcaaaagtaagtgcctcgagcaacgtaccacgcggcaggcaacgggcatctgtcgtcggtaatttttgggattaagggataatctgtttttaatctgtgattagtgttgggtgttacggagtcacgtgcagattgtgtgatagacttaggggacaaataaaattgaaaaaagaaatggtttttaatttaatagttttttaaaattaacctaggatgtggggtttaaagatgggattaagtagaaaagtggtcttgggcatttcaagttatggagattagtgaaatgccattggaattatatattaggtttgctcaaaaattaaaataatgaattggaaaaatggtttaaaaaacaaatatatattcatatatatgtgccaaactagttcgagtattagattgttgatggtcattaggtaatagtcctaatattaaattgttgatggtcgataactagaaaatcaataaaatataaaaaatgattggtataaataattgtgctagaaattaaaagggagaataggcaaaaatttactcttacattgcggaattgaaactactattttatctatgaactacttggaattcactactataattttagtatcgattacactttattattcaatatctagtagatccatagaagtaatatatatatatatatatatatatatatatatatatatatatatatatatatagcttgatggattcaatctgtatgttattattattgcatatttggaattatagatctataaaattttaatgaattttcatattaacacacgtatataaaagttatgtgtcaaaaatactagatatagttgaacctataaaactcatattgcaaccgtctctaagattcactcagaggcggatacacactataggtagagaggtcatcgacattcgaaaacttgcaaatgtcttcaagaaatagtcagatataagcatataccgttattaattttttatgaacaatgataagtgtaagttgagcttcaattgagctaggtcatggcctttattaatggagcaatgtaacagactgtgcaaggaaaaagaaggaggagagagaaatgaagaagaaacgtttctgtatattcaattgtgtaaacaataacatatacaaactctatatttatagatacaactaacctctacttaattaagctaagatcactaactattggtaactacctctaacaatatcaactaactctgccagctatcctaactaacttgacggccggctcattacttagcgttgcacagtcgactccttcattctcacacttcccctcaagctggagggtgtaagatgttgagcactcctagcttgcctaatagatatttatgttgtattcttcccagccctttagtcaatagttgcatgttgatccttagttccaatatggcgtgtcttgatccttccttccttgatcttatcactaataaatgataatatatttaaatatgcttggtcctttcatgaaatatgggattacctgcaatttgtaaagcagctttgctatcacacattatatccactggttgcttgacatatacattgagctatgcaaaaatcccagtaaccaaacaatttctgcaataactactgctaagcttctatattctgagcttctagcaactgtgtgtgcttctttgacttccaagacacaaatgggtctccaaatttaaccacaaacccagtcactgatcttctagtgttagggcatgatgcccaatctgcattacagtaacaaaccagactgtttgcatgccgctactcatcagattcccattcttgaattctgtttgatgtatttcactacccttattgctgcttcccaatgggattacttaggtgattgcatgaattgactcaatgtctgcatagcaaatataatatctggcctagtgattgttaggtatctcaacctaccaattaacctctaatacgctgaaatgtctgccaacatctcatctccaactactccaacatgtctaaaaaattcaactgagttttgattcatatcaagtggagtagttgctagctttgttgctctcagacctagatcagacaccagttggagtgcatacttcctatggttcaacaagatcccttggttggatctcatgacttctattcctaggaaatacctcaattctccaagattcttcactttgaacttcctatttaaaacattcgttgtctcctcaataaattcctcattattttcggtgatgagtaagtcatcaacatataccaacacagctacaaattatgtttattttttcttagtgaataatgagtaatcatagagactctgactatagccagcatccagaagagtttcagtaagtttgatgttccattgtcttgaggcttgctttaagccatacaaggatgtcattaacttgcaaatttttgtctcccccagtcttttgaaaccctgaggcagttccatatacacctcttcatataggtctccttggagaaatacattatgaacatccatttggtacatgttccatccttttgtggttgccactccaatgactgctctcagagttactattttggcaactggaaagaaggtctcatgataatccagacttttcttttgactgtaccccttggccactaatctagctttaaatctttcaacttctctatttgctttgaactttatcttgtacacctattttgagccaatggtgttctttcctttaagcaagtctactatctcccaagtctaattatcttctaaggccttaatctccaactgcattgcttccgcccatcttttgtctttagatgcttttgcaaaactctgaggttctgtcagtgaagagatctttactacaaatctttggcaagatgctgacatcctgctatatgttaagtggtctgatagaggatacaatgttgttccatttgccttcttttgtgtcacataatccttcaaccataagggctttttgacatttctgctagatcttcttggttcttcacttgcaagggcaggttctatctctggtaatgtgtctacatcttgtggcaggtacattgcatcatgctcttcctcacttacgatgtcatataagcttggtgttgtacttgtttctccttgtgtatacttatttgctgcatgcctattatacacttcctcagtaggtacattatccacactaggaattggagttgaatccactattgatgaaactacagcttcttgtggatgagaggtggatgcaggttcaatgccttcgtgatcttcttgttataggaagtcatgatcaactggaaatggttcatgattaacctacacactccccatatcatggaccatcggatgtttccataaggaaggctgaacaaaagaaaataaatgctccttaaacacaatatccctgcaaacaaaaaattggttagtagagatccagcagcttgtagcctttttgagtttttgagtacattagacgggcttagatgggctgctggtttggctcttgctgaaaatttattttcatgcaccaaagtagtagcatagaagagacaacgaaatactctcaaatggttgagtgaaggatgtgtatgatacaacaactcagaaggtgttttttcatccaaaacaaaagtaggaagcatattgataaggtatacaatagtagttatgcattctcccctatatctagttggcacattagcttgaaatttcagtcttgttgtgttaagaatgtgtttgtgtttcttttctaccaccccattttgctggggtgtgtatgcgcaactactttggtatactataccatagtgatcaaagaagttactacattatttattaaaaaattctcctccattgtctgttctaatggtcttaacaactgcattgaactgtgttctgagcatagaaagaaacttctgcaatattactataacatcactctttaattgcagcaaatggacccacgtatatcttgaatgatcatccacaatggtcaagaaaaaaaagcttcctatcatgtttagggaacttatgaggaccccagatatccatataacaatagaaaaggactaacacttttagaacaacttctaggaaagaccagcctactttgtttagccgaaaagcaaactgaacaatccttatttacatttcgatctattgttgcatgctaaaagacttgatatgcttcagtgtgctaactgaggcatgtcctaatctcttatgccaaaggtgaccaacaaattctggcttttagtgtggttgctgatatctgatgcaacacttttgctataggtgcatcattcaccacatataaacctccttttaccttactaatccctcttacccttccactccaaaggtcctgaaatacacagaagtcaagataaagatgaaatgagcagcaaagttcctttgtgagtggatacagagaacaaattaaatttgaagtccagaataaatagcacatttttcacctccaaatctttaagaatggttgcattaccagtatgtgtaatgtcagttctctcaccagtaggcaattgtacctgttcttgttgttcacctttcaacttagttttagaatgtggtaagtctaatgaggtagctatgtgatgagttgcaccagaatcaactatccattcactatttgagcaattagtcattagagatgtggtaatacctgccatgtttacttgtggtacagaagtatccctattcaacatacttgatcgcagcttgttcctttttctccattcatcagtgtttgttgttcatgttcaagaacaccagtagaactgttagccaccactttctttctttttttccctaaagtctctgaatatcctatcaatttaaagcaattttccttcaaatgctcattcttatgacaatagtcatatctcatgaaaggtttcttccctttatagggttgtcctctcatctaccagcttgcatggaattggcttactctacgaattgtccctcgactagcctgcataacattgcatctgctttaacaactaaggttggatatggacttgacctctgactctcatattcaataatcagggcataagcctgattcactgttggttatgtgtcttcattaggatttatctccttgcttgatcatatgattcattgagaccactcagaatttgaagcaacctctgttgatgaaggtgcacgatataatcctttgatttcactgtcacatctaggtgaggataccatagcatcatactctgaccataactcattcaactttgtaaaataggcatccacaaaatctgttccttgtgagattttgcaatttctatatacaattggaagatccttacacgattaaccttatcaaacctctcctttaagtccttccagactaaatgagcattagaagcataaacaattccactaattaggttctacgatactgtattcatgattcaggagaggacaatcgcattgcatgtctcccgttcttcatatagttccttcttaaaggaatcctttttacaaataccagacacaaaccctaatgtacgtttagctagaagtacaattcacatcgttctctcgccacaattcatagttttcaaatcctgtgagttgaattggaatcaaaattgaactcggcgtgtcagaaggatgaagaaataatggatgagtgtgatcgatcttatcatctcccattgttgagcttaagaggaagatcaattattagaattgacaataaaaaagcagcgttcgtgtactcccagtcacgactgctcagataccatgtgagttgagcttcaattgagctaggtcatgacctccattaatggagcattgtaacagtattgtgcaaggaagaaggaggaggagagaaaaatgaagaagaaaacttttctgtatattcaattgtgtaaacaataacacatacaaactctgtatttatagacacagctaacctctacttaattatgctaagatcaataactattggtaactacctctaacagcatcaactaactctgtcagctgtccaatctaacttgacaactggctcattacttagcactacacagtcaattccttcattctcacaagtttatattgaatattatagtgcccgcaaccgctaaatcctgaatcaactcactagcttcaatggccttccctatatgtaattggaaccaactattctttgagaaagaatataactttaatgtttaaaagaaagaaaaagtggcagtgcaccggagtatctagtagttttagtcaaaatctaaatttgtatacgggttcacttgaattcagtatctttttattcagattttgacgtatattaaaaattttactaaaatatctataaatatacctgactgtgaacctggttattattatagtattaacttgagatcgatgtaataacacataaacctcaaatcctgaattcacctatgttcaatgtaataacacataaacttcaaatcgtaaatccgcctttgtttacggttgacaggcgatgaacaaactgcgggaggcatgtggtttctgtgttttagtaggcggaaacagcagatcagactcatataaaaaaaacatattattcaagatgtagttgcagttgtgcaaaaatcagcatgaagagtacttatgtttatggtaagagatatggtggacatgcagaaaaaagaaaagtaggtgactgactgtcaggaaaaaaccttaattagttactacatatttttctgtaaactctttagttaaaaagtggacacagatttgagagagtaaagtggaagacgacagagaatcttttgtgggactaacaacttgaaatgacttgtactatatacttctttagtataactgttttgtttccttcaacttagtattatccctgaacggcagagacggatttagaatttaaaatttaaggattttggagtttattatatttacatattttaaactaaagttattagatccgtcgaactagtacttttccatgctagctatccgcccttgcttatagtatactattaagatacgtaaaagtagaggcggattcaaaatttgaattttgtaagttcgaaattttatggtagggctttcaagtgctaataaaaaagtactagcaagtagtactatttttccttttctttattttactctctagaaggggaacttttatgtaactggtaaagttgttgtcgtgtgataaggaggctacagactcaagtcgcggaaatagcttcttggagaaatacaggataagactgcatacaatagactcttgtgatctgactcgtccttctccggaacccccacatagcgagagcttgttataccgcgctttcattttgccctttttttatttgactccaacatccactataacaatcttttctctgaccatctgacgtcccaccattgtcccatgactccttttcctttgctttcccataattagacatcaatagtatatctatatacaaaccccacttcctaatttcccttaaagttccttttttttccatatacttaaattatttgaaagtgggcatttgaaagagcaccattttttgtccttgctgaagtcctttcactagttttactactacaacaagtcaacaacaacaagaagctagctgccccctcaagaagatgtactacactagtcagaaatagctggttagtttgatttctccttttgagcttggttaattattctatatatctttgaaggggagcgttgacgtagctggtaaagttgctgccatgtgacaggagattacgggttcgagccgtgaaaacagtcccttgcagaaatgcaggataagactgtgtacaatagactcttgtggtccgtctcttcccctgaccccgctccatagcaggagcttagtgcaccgagctccgagctccgagctccgagctgccgttttatttttggtgttctagtttcaagctttttgtgttggtcttctaatttttggcttggattttagtgaggattcatatagccgagcccatttcttgtttggaactactgcgtagtagtagttgtatttcagtaaactaactttctagtactttatgttttcttcattaatgatcctatgtttcaaatcttgaaatgatttcctcttgtatggaggttaagtaggttaataaagaaaattttcattatcctatgcaattttcttgtagctgaaaatctacaataaattagttagattttgtcaagaaaaaattgaacctatcatttttttttaagctatagatacttttgtggaagttatacagttgactgctttgaagggagccctggcgtaactggtaaagttcctgccatgtgatcaggaggttacgggttcaagcagtggaaacaacctcttgcagaaatgcagggtaaggctgcgaacaatagacccttgtggtccggccgttccctggatcctgcgcatagctggagcttagtgcaccaagctgcccttttataccgttgactgctttcctgtagccttttttggaacaaaagatctaaacaagagttgtgtattatcataaatctttcttgaattatatataataagtcatatatattggaccgagacgagtttaaatagagcaatatggatagtgcggattcatatagctttgatgccataatcggtttcatctgtatgctgtaacactatattggaagatacattaaacttatatatacagtcatatctctctataacaacatttcgttccactccttttcaattcatttctcggttcaacaatttcaacaccacgccccttctccagggcagcaaatgggtctagagaaccgaactatctcacgacttcacctaaataaagacatagcgttttaagaggttggcgcctggtgtctaaaccagagacatcccctgtataacagccattcactttaaaagtctaagtttttctcggaatcgatattcatgttatgttataatatatgtcctctataacatcccttcactataacaaccaaaaaatatcggaacaaacgaagctgttatagaaaagtttgttgtgaaactagtgcattgctactaaacttgtatatatttactcaatgcatatctagattttggttgtttcagtgattggaatttagttgcattaaacttgtatatatttcaacaaaacctttttcttttgatcatatacaggacaatgatactaattcgaagatagctcatttgtttccatcgatcactacacagtgtaagttcctaatatttaaccaaaatgcaaacagcaagattcaatcttgaagttgaggctttgtttgaagatgatttctgatattatagccaggtagcttctaatatatgtaccgttgaatcgttcatggatccttgcatggacagagttatagatttcactaagttaagttcagaaccagtgtcacttgacttgtcacttagccaggattcaataggcttttcagtttccagcacaagtgaaagtagcaatgaacttgcaacacaaaattcaggatcaggatcaggatcaggacaggcatttcaaagagtttttagttgcaatttctgccaaaggaaattctacagttcacaggcacttggtggccatcagaatgcacataaaagagaacgaatactagcgaaacgagctatgagaatgggaattttctcagaaaggtatgctaatttggcatctttgccattacatggatctacaataagatctttaggaatcaaagcacattcgtcgctacatcagggatctgcaccagcaattaggccactcgattttaaaacgagtgcaagatttgagtatggtaattgccagagtccacctttgtacatggaaaatgatgaagctgatcaattactatggcctggcagttttcgtcaagtgacaaatcccggtatctctcatactaacttttctcttgccggatgttcaaatgagacttcttcgtacgacgaaaaagatgaaccaattacgccagatctcacccttaggctttgagaagtttgacaccaaaaacaccagtatcatttagctatcttattttatctgtatagtgacatatatattgtcgttagtgtggattctgagaaagtagaactttcacagattattatgctggatttttccgtttgctttgtatcaagatactgtgcacaatgccacaatgcctgctcaggccagtgtgatttggacaatattagatgattgttgtacaagttgaatgtattatttatgactagtaactgttatcccagaccctacctggtgggaatataccgggtttgttgttgttgttgatgactagtaattgttatctgacttggtattctttccttataagcttgtatttctattaagtatggacgactataaccctgtgtgtgcacgcgagcgcgtgtgtattgatatctagccagttcttgttagttgcaaaatggagactagaatagccaagaaaagaggaatgaatgaagaaccaaaaattttgccaaaaactatcatttaaaaggccttgcagaggttctgagaaggatcctattctcattttgaatgatcttttctcatagtttcttaagcattttggaccttgaacttgaacggagtcttggtataactggtaaagttgttgtcgtgtgatcaggaggtcatgggttagagccgtgaaaaccgcggaccacctcttgcagaaatgcagggtaaggttgcgtacaatagacctttgtggtccggcccttctttggaccaacgcataacgagagtttagtgcaccggtctacctctttttgtatgtattggactttcaagaggcaagtatctgccccaaattcagtctgtattaagtttacatcgagttattattagtataatgtgcacaccagcttcaagtagaagttgatcatctcgttgtttttaggctagtgacttcacggtatatacaacaacccagtataatctcattagtggggtttggagaggatagtttatacacagaacttacccttaccctggggtagagaggctgtttccgatagaccatcggctctctccctccaagaactcccaccttgttcttggggtgactcgaactcacagccttttagttggaagtggcaattgaaacaaataaatcaattatgtggcaactaatatttgaaaaatctccacctagctgatttttcaaattttcttcactcccatgcaccttatagagattgtattcacgctctttgccacatcagcatctagggggtcaaaactatcgatttttctaattcagagaggcattaaagaccacgtgaagtttaagaaggaattaaacaaaagttgtcaagtttaaggggtcccgaatatttctgcctgaaaaaaaaaatgaattccaaagattgaacaaggaaatcttatgagattttcacgacttttttgcatttatatgacttaatgtatacaccaaattatattatagtttttatttatttatcatagaaatttgttaatcaaaattgatgcaatcattccatttgtggttgacatcaattgacttgaaaatttgaactactaataataccttcaactatcccaatttggactactttgtgggcttttataactgtatatattttcatgaaaaaataacattgtatagccgtcgtaaaaataataattgaaaaatatataaattttatattttttgtatgtatatacattttacatgttatatacaaaaatatacaattttatatatttttcgactaccaaatataaatagtttttagcgcgggctaaaagtgataatacccctgtattcattcccaagttgtcaactacagatttatagtgcttctactatgatacctgctgacttagatatattacaatattgtgcaagccaaatgacaagttggggcacaaaatatagtaaacttgagggaaaataacactgtataggagctctcaaaattatagccgaaaactatatatttttgttttgcatatatatatatatgtatggatgtatgctatatatattttatatactttttcggttacgaaatgtaaatagtttttatcgcatgccaaaagtgatctttgccctgagcttaatgaactgtaaattagttaattaaaccttattctcttttgacatttttacacagtataatcgtccaaaaaataatagccttctcttttgacttcatatatacatatatactcttatattgattgtgttatctattaatcactattataattcaaacaatggaatctcaaatgagataatttagtgtttaagatgtcaatttgatattcggaaaaatgtatatatttttccattgttgcctcacattctaatacttttaatcttttttgagtatcaattatattactttgtgcttagtactatattttaattgtgtaagaataaaacagtatgaagataaaaagatgtgaagcaaaactggataaaacgtgaaagaaaaaaaaaagaaaattaaaagaatacaaaaaggggacaccctttggtctttgtccccttggtggaagacaagcaaataagaaaccacaactagcaagctaagatttgaagttgaaaacatagttgaaaacgtactgttttcagcgccagggccagcgtgaggcggagggtttttctatttcgtcgggacaaggttatttcggccttacacgatctcaatttgtataaaaagggtcctaaacctaatttggaggagatctaacatactttgaaggagaatttacgtggaggaacacacaccacgtttggaggaggtttctaactagttttcttttcttctcttcctgtaatttcatagtttcttagttcttgagttttgggtgctatatgaacgttgtagtttgaagcttaaattgttcttattattttatcacactggtttatttattcaatcttgcacttaattatttaattgtttgatcaccaattgaataatatctacgaatctaagattgaactcgggaggaggaattctagattgagtagagcaagatagtttgagtggggggcgaatttgcgtgttaggatagggaatatacctaatcgccttgcttggttactattagggacttataaatgcggttaggatagggatttaagaggaaaactcaacggaattgttagctaacccttagctctagaatattttctctcatagattcatctctaagattgcaaatttgtttctttaatttcttagtttgctactctagattaattgtagttaattaataacactttagaaaatcgcttgaatagattaattgatagttaatcacaaatccctgtaagtacgatatctggactacaatcctatattacttgtcgaccacttatacttgtgtgtacatatggaagtaacacaattcgtcatgacttcaaattttaatagttcaacatgattgttaatcccaactacagacatattagagccaaaactgttaagggcattccatctaacgtaagcatctgaatattctggaactctgtgtggcataatctaatgttgggtcgaatgcaaaataaaaaagagaaggcctttcgattgttgcatagttgaggaggctgatcacaaatgctacagacgtgagagtgatccgtacatcgtcttctttgagagaaaaaatcaagggattaagtggtttttgaacgttatctttaactactaagattttttaattcgctaagtttgaaaagttcaaagagcacagacttaccacgaagcttgcatacagtctgatgggactgtctactgtttgttggagttaaagaaaatgaaccagactcttcaatttggtacaatcagaaaagaagaaaaaaaatggaacaatcaaagaatgatgtaacattagacaaccagaagaagacaggcaaatagtccaatttgagcatttaaggaagaaaagaacatgaccggtaggctacctgatcaaaaatatcgtcaaaataatacgggctagtcattttacggattgataatcggaaaaaagtcagtgtctacgaagtcattaaaaattttgttttgttcaaacgcgaaaagttccagcataatatgcgggattatggagctcttgcatataaactttcagcatattatgatggaaatctagcatattatgctggaagctaatatgtaaagaattccaacatgttatgctggaatattgtaaaaataacatgggctagccagtttttggactggtcattcaaaaatagccagtgtttgcaaattcattgaaaaatagtcactattttgctgcaacacggaaagttccagcataatatactggagatcggttcacttgtatatgaacttccagcatattatgctggaactccaacacgcggaaagttccagcataatatactggagattggagcacctatttatgaacttatagcatattatactggaccggtataatatattggaactccagtatattatgttggaagcccagtatacagtatacttatgctggaattccagtatatcatactggaattccaatatattatgttccgattttgaacaatgatttcgttcagatttatctttacatgaaaagtggctaagtttcgtgaaactgtggctatttttgagtgacgacttgtaaatcttgctattttttaatttctccctgaaatatttccggatttttaatagtgtttttgttcagattttatctttacatgaaaagtgacaaaatttcgattacttttgaaactgtaatttatttttcaattaatagttctaaatctgtctatttttaaatttcattcataattattatttgcaattaatggttttcggggtttagggttcaggtttctaagttttaccaaagaagtcgtcaaaataaaaattctattgagaccaaaacagccgcctccatatttaaagaccttctagcaaaagtcccacccctatgtggtttttttaattttattttatttttatgttattttaatatagaaaaaaaaatatatgatacttaatagtaaaaatattaaaaacaacgtgacagttgcatcaagacttattcatgtagacctcagatagttttgactttttacgtctgaattttgaatggaattatataaatatttttgccgttgcgagtgaggcattgccaaaaagaaaaaatatgttattaaaagaattatattaacagttttataatgtattgtatcgtattatattatattatattatattgtatcgttttatgaatataatgtttggatagattgtattgtttaatgttgttaaatgatattttgttgtttggattggttgtatcgtattgtactgtaactgattaatttactaaaatatctttaattgtttaaatattaaatttctcaagaattacgtataaaaataatttaagaaaactgccaaaaagcatccagaaaaccgactgaaatcggttgaaatccaacaaaaaccggccgctttccgatcgttcattggacgtaaaataatggtcacaaacggggagcgactgtattcggtcgctattttccgaccgaagtcggtcggtaactgtcaacgcagtttgaccaagttgtctaacacaaattaatttaccggccgtattcggtcggtattgttaaaaacattttttaattattttaaattagcgatcgaatttggtcggaaatttaattattcaattccgatcgaaatcggccggtatttacaaatatataattaatcatttttatttaaaattattaattcctaccgaaataggtcggtattatttaaataattaaaatttaaaatcaaaaatccgaccgaagtcgattgttaaatttgattttcttggaattaaaatgaacattttcaaccgaagtcgatcagttttctggataattttttggtagaaaatagttgttttatagctgcactacctgtcaacaacctatcacctataatggcggcattacattattgtcattccaataacaacaagaacaagaacaatacttataccttgcaatccagccctgtaccgcataaatgatttctctggaataccgtatgctatcccctttttcggaccaccgataaaatccaaccatatcttttgcgcttcttcgtctgaaataggtggtcgctcgcgttgctcttcggcggcaagctctaagtgtactcctccacattagccttgtagcgaccctttatttaaaagatagaaaattattaactatataatattataaatattaatttcaagttatattagttatgaagcttacatatacagtctccgcccggtcctcgatccatctagatagatctgtcggtgccttcttcttccgaatgtaagtctccacgaagaactcatcatgagtcatcttcctcctatatttcttttcctacaaataataataaacatgtttaaagaccttctagaaaaaatccctcccctatttggttcatttttctttgttttatttttaataatatagaaaaaaagaagatgatacttaatagattgcacacgaaatcgtagatagaatgttaaaaaattaaaaaattaaaaaaataaaaaaaaataaaaaaaactcattaataaaataataatcaacttcatcattattgcatagaaatatcgataataatctttcaaattataattataggtgttagttcgattttctcttcttcattaattatctcgttctccttccatttatctctctttaatataatagtaaaaatattaaaaacaatgtgacgaaagaagaaaaggaaaatattaggaattttagatagtgtactacggttagacttctctagaacaacatctttatataacaacatttttatatagcaatcaagttttttccggccggaatcaacttttatattatattataatatatatcatgtataacaatacttcattaaaaaatatcaaaacaaatgaaggtgttataaagaggtttaactgtaccaggagaggctaaattttgatatattaatcgcgcatataaatttaagagaaaaattgatctaaatactaacaaaactataatatcaaaacttatattcaattaatttcatagattctaaattgaggaaattgtcaaaattctttacaagtataattctataaaaatataatatatcctacaatggatacaatgttatataaattgggatgactaattaagcattaaaaaatgtaacttacttataaaaaaatcagtagtactaagagaatgtacattttcacaaatcacacctattgtttgttaatattctgtatttgtacaacaattctggataaaataaataacataaacagaaatataaatgaaataataaaaaccaattcgagcccactgaattcacggtgtttccttaaggaatttaatcccctcctagtacctaaggttatggattatttcctcccaggatagaatgaattacacactgatgtagtagtacttcaaaccccagtgtttcagcgaacacaaagttcggtagcaaatcacaattactgttgctttctttgaagtaaaaatatgcagaaggaaggaggagaattcagaaattagtatataaaatttgagagataggcttgtatttatagccaaagttgggctgaaatatgaagaggttgtttttgcaaaacgcccatagaataaatgtcgtgacataattggctatttactcaacaataaagaggaaaaattgaagggtagttaattttctgttacaacaacagaaaactgaaaattgaatggatttaatattaatattaattttaatattaatattttgttattaaacaaatatttaataacatttctgttaatattttcaaagccgagcgagcgacgacgacggcgcgaggtttgccttcttatcaactttttaagagctagaagaagagcaattgcttatataccctcaaaacctcgtttgttttgatattttatttttccctccatttcccattcaccatattttaagcttattaatacttaaaaacccaacatttttgagatataaattaggctagtatgtggcacgtctacgttatgtaattaaatagtgcccaaatatttgtgacatcaattaaattgaaaataaacaaattggcaaatgaacaaaacctaagccgcctgaaaacaatattaattttctaggtataaaataatttaatttctaggttatgtataaaagtagatgacatattgtaatagtacatgattgagaatatagtatgaaataatattcgaaaaccacgttaaataaagcagaaccgatcaatcgttacattacgatatcaaattatatttcaatgaaattacgatataatataaggaaacctgtcctcgtgatttttgtattgttcaagatttgaacaacgaaaatagacggcgagtgcgtgatcaaattaatttgttagccgtcatctttttgaggtaaattaattttaacttataactaattcagtgtattggttgtattgttgtcgccatcgtgccatgtgatgactatgacgttttcttcactaattttctggtaaaaataaattgccaaaataaataaataaataatcctccttccctgtttttcgttcattgatacaataacaaaaatataaattatatacgtcttttattctttacaaagtttggccaaaaatatttttcatattagaaaattaagcaggcattattttttttttaattcaacacacttactagtactactccaaaatatatatatatatatatatatatatatatatataatcatcaattacataatgtaatttagtcaaaaatctcttatggttaatgtaattatatgattatttttaattaatacgctaaaacttaagacgaccaataaagaggatagaagatagtattataactggtcttctatagagtgatcaatacaatttttttatgttttacaggaaaattgatttgaagaaaaagaaataatttaactgaaattcacccgtcaagtttacaacaatttatgaatagacgtggttacagacagagacggactcaagaattcaagatggcgaggtacatgagcaaactattcaatcagtatctcgttggacttttgatcttaagaattttaatcatatgaacgtttttaatatatactccttctgttccagtttatgtgaacttatttcctttttggtccgttccaaaaaagaatgacccctttctaaatttggtaacaatttagtttaaacttacacttaatgagaaacttttataaccacacaaatactctgggcccctttttgacttgtttagaatcacaaattccaaaagtcttcattttttcttaaactccatgtctagtcaaacaggttcacataaattgaaacggagagagtatacacttatatatctagaatttttacagaatttaacgggatccgattacttcttctttaagcataggtccaaccggtcacaaagggtagttataaaaatcactaataagggaaatagtctggagtggacgtctagatcggagtgtcggcatcgagcttgaatcaagaatggatccacaatgtaataagcgggttcacgtaaattcaatagtttttgctcaaaagtcaaatccggtatgtgataacaaaacttagattaatttctatcaaataaatcttgagctcctgtgtataaatgggaaggtaaagttccatttaattagacaggataattgatttgcagttttttttcctttttttacaccaaaaaataattatagattgcgaataatccaagaaatccaacagactgtacatttatttatatcatactatattatattattatattatatagaaatgaattttgaggcaatgagtggttttccatcattcattgaatcaatgggctctttttcttttctcttgttttcctaaatgatgccttaagtttgggctaagtctatttttgtccatattttatgttgatttcatatggtcctttaagtttacagagattgagcacttctgatccaactcaagaaactcctaaaattgatctttaaaactaatggaaacgttatataattttgaagttcctaacttatataacgattgtgatcgggatctacttgcccgtcatagttttattttcattactgatacatttttttctattcgatttttgtgtgatcagtgtagaattgaaggagaaatataattgaggaagagtatctcggttgggattattttttactctagtcacgtgaaaagcacgagaaatattcattagctttaatgtcccatttggatattttgtcaattagatgagcgcgtgacatcatgaaatgacaacaaacaatacaatttatccaaacgttgtattcatcacaaaaatacaatacaatatagtacaatacaatacgatacacattatgaaacgacatgtaataacaatccaaacaagctgtaaaagtgcttgactttttgcaaacttaaagaaccatatatgctcaagtaatataatagagactaaactagacttaccctcaaatttcagggaccatatgtgttaaaaactcttattaaatccataagaaaaaaaacagaaggagaaagacagataatactctaatattctagctctatttccagcagatgatccaactttgaacatgcattaatgttgtcataatacacatagttgactattttctgctgtgtgtatagtataaaataaaaatatctttcatcttcaaacatcttgtcctttccattgcattcttacctgaacttaattctctggaccaaattctaagacatggctactagctatgtctggtggtggagctggtggttcacggtggcgtttatcggttgtttatcgatccagaagccggttttttccgagccacaaaccaacctgttaggcaaaggatgtagtcaatacaatgcaacaaatttacctgattttttcagaagacttaatgcaagttttgatgatttaaggaaccagttgtctaatcaagataagcgattcgccacgacacaacaggctatttatgctatggttgaatgcagaaaatatttgtcaaaagctgattgtgtctcctgttatgatactgctgttactctcatcagaacttgctctggtgctaatggtgctcgtgttacctatgatggttgcttcctcaggtgagttatgcctcgaaactagttggagtcgactatattaagaaatatctatggaattgctctttgtattttcacatcaattttcaagattttggcctcttcttcaaaatttccaataacaaagaaactattgaaaaaaaaaggcagcccggtgcactgagctcagctatgcgcggatccggggaagggccgcaccataagagtctattgtacgcagccttaccctgcatttttgcaagaggttatttccacgactcgaacccgaaacctcccggtcacatgacaactactttaccagttacaccaagactcccttcaagaaagaaactgaaacaaatatattaaatgatatgcagcagcccttgattatgataaattattgatgttgtttgctaacattcaagagtcaagattattggtaacagcaatatttatattactgtttgattgcatacaatccctaatactaacctataaacagtctctcagttgtttggcatgagatcatgtatcttcttgcggtgaatcttcaattcagataaaatcgtcacttaaattcaaaaactgtggatagtcgaacttttccatacgttttagtctgtaatgtgaagaccagtttctgaggcagtctattttctcaggcagaaaacacaaacactttgatagtctaatttccaatatactcattaaaatggctgcttgtgttagaatgtaaagataaaaagggagagtaatatccttctcataacttacatgaactcattgctccactgatgcgttttttccaaaggtacgagagcaacaacttctaccaagagactacactcccgggaaatgcagcaatttgtgggaatcgaacagcttctcagccaaatactttaaatcctgtggctcaacaactcttgaatgatcttagcatggcaactccaaaaattagtggcttctacgcagccacgaagagggaagtcgctggtgttactctctatggagtagcacaatgtgctgaaaccattactaaaagtggctgccaagattgcttgacagtggcatataaaaacatagaaggctgcttgcctaaatatgcagaaggaagagctgtagatgcagcctgttttatgaggtactcaaatagagcctttttcgctgataataaaacaaccgatatcacgccattccttggcgaaggaggtaggaaatgaagcttgctttcctcgactcttaccagccatgttgcgtggactctccaaaatgttgccgtacccgtgtcggatccaccaaaaatacactatttttggaggatccgacatgcaccctgtgacattttttgagtgtccgagcaacatagcttactagtatttattcattttaagactgaattaataattggtgggggtactttatgcaggaagctcaaacaagaagaaagccggcatcattgggggtgttgttggaagtgtaggacttcttttgattgtattggctgtgttcctatggtatcgactatcaagaaaaccaaaggcaactgaaagaggtaatatttgatgatctttttctcaattaagtggtaactaatatagtagctcttttcatttgtcctttcgtttatttatgtagcatatgatatggtatctcctgttcaggtaatatactgggagcaactgagctgagaggtccaatgagctacagatttaaggacctaagaattgctacccaagatttcgatgaaagtaataagcttggtgaaggcggttttggtgatgtatacaaggtacggtaacactgaaacagttgaagatcctcatctcaatcaaattgactagataatcttgatctaacttctattcatttatccacttaatgtaattgaaatgatgattctaatgttattgaacagggaactttgaaaaatggacatgtagttgctgttaaaaaactagcaattttttcaagcagagcaaaggcagattttgagactgaagttcggcttatcagtaatgtccatcatcgcaatctcatccgtctcttgggatgttctaacaaaggagcagacctactacttgtttacgaatacatggcaaatggcagtcttgagagatacttatatggttgatttttttgtttatccagcttactattattgtccaagtcaaatcgttatgttcaagaaaatttaaaataatcctacctgtcaatgttttgcaggagacaaacgagggatgctcaactggaagcaacgatttgatataatctttggcatagctcgtggccttgcctacctgcacgagcaattccacgtctgcatcatccatagagatataaaatccagcaatattctactagacgatgaatttcagccaaaaattgctgattttgggcttgtaagacttttacctgaggatcagagtcatgtcagcactaagtttgctggtaccttgtaagtcaatttgactgctcgagtttcttatctgatatcactaaaagcattatgagaacaacttgatgaacactaattgaaacaggggatatactgcaccagaatatgcaattcatggacatctaacagagaaagtcgacgtctatagctttggagttgtcgttcttgaaataatcagtggccggaggagcaatgatatgcaaattgagcctgtcactgaatatctccttgaaaaggtctgttttcattttcaaattccacttttcctttcatagtttactaagtattctcttccaacttctctgtcccattctaaatgcacctgtgctatggtgaaaataggcgtggaaacttcatgaaagtggcatgccagaaaaactggtggatgagactttagaccccaatgaatacaatgaacaagaagcgaagaaaatcatagagattgccttaatgtgtacacaatcaccagcaaatcttaggccaaccatgtctgaagttgttgtcatgctattaagtgatcgtagcacagacgcgcgaactccttgcggcctactgtcattagcatggataagagtacaccggcggactcgtccattactactagatcttcagcttctaatgcaaccaatttttctgatttcactggccgctagctacataagagtatactttagacctgaaaattatgctggcaccacagcatctgaaaaaccatggaacgtatgctacagtgtaaaatgaccactatttaagtattatacaagtattagtttttcatggttcatatccgtgactgactgtgcaaactagaactccatcatcattgcagaagcaatgagaaaattggtatcttcactgaaagtctcaaatgcctcaaaaacctgtcctttcttaacaaaccccgctatcaacgaattccaacttacaacatttctctcaggtatttcctcaaacaccttcagcacatctttaaaacacccacactcactgtacattcccaaaatagcattgtacacaacttgatcaggttcttattacccctaacaatctgttcatgaacacctctaccgaccctcaaatctgaaagtcccaaacaagctttcacagccataaataaagcaaaattccccggttcaatggacttaaacaacatttgacaataaatcaataatgcttccctaaaaaacccttttttagaatacccaattgccattgaaacccaaactgattcgggctggtcctcgttttcaagcgcgtggtgctcgaaaacacgacgagcctcatctagctgatcacaaacagagaaaagggtaattaacttagataaaattaaagggtcattgagaaatttacttctgtttggatttaaaagaaggtgaagatatagcctgtgaccatgttctaatgatttctgtgaaatgcgcatggaggagattcaaataagattctttgttttcgggttgagaaattttttgggattctaataggagaagagcatcgtttagttttccggatttagtgagggatttgagatttgtgttgaagggttttggaggagttttgttaagcttgttgaagcttgaagtagctgttatggtggttgtgacagttggtagagaaatggcgggaatcgccattggtgtcttctgaaaagttcgtgataaatttttggggtctttttctttaaatacttaataattaacagaattttgatagggaagaaatattttagcctcgggtgatttacaattatatccttaaattacacaaatatttaaggttataaaagtcgatcaatatttcaggaatattttagtcgttcaacatttatcctaaattattcgcgcttttataataactagtctctgggcacacacattgtgcgtgtacccatatcaataaatatgaaaatttaaaaatcactatatcaatattataaaaagaatataattgagtgacaaaaattaaagaaagaagtataagttcttgatatcttatctggatatatttattagcttgtttcaaaaagtcaaaaaaacctttaggtggcaaaaaattatatacttcgagtaaaatctaaagaaatcatatcggaaaaatatttatctgaaaataaaaagaaagtgtttaacctcgtaggctctctgagtcattaatctctcgtcggcacaaacgcctcctctaacttgttgcaacaccaatcttgtccaaaggcaccaccatgtccaataacttattaaatatgtcatccataccggcaagtgatttattagactcataaggtaacctataattgtaaagttagtttgctttattactactgacgaaaataatggcagactttatcttccttataacacaaggagagccataaattttaccactatattttagtttgtttatagaataatatgtctatcagatatcattaattatatttttatctggaatattctcaaagaaaagattctatgaatttaattgagaatacaaagagcatcaaatatttttaatagaccagatacattaagtaattttccaattaagactaatgggcaagactatgaaataaaatgattaaagagtttcaacggaatattagatgaatttagtttagactacaaaaatgttttgcaagtttgaaaaaatattttatatgttaaaatatttatgttttcatgtaaagtgtagtagagaattaaaggctcagtttattatgagatattttaccttatagtacaaaaatgatataagagtaatatttaaatgaagggcaaaaacgtcacttggcttttaatggatattttggtcttcaaactttgcattttaccctttacacttataatatagtatgatatagatatagattataactgcctccaaaataatagccttctcttgtgacttcatatacatatactcctatatatatatatagcgtacgtgcgttgcacgtgcatgcaaacgtctatcattaaaaatcatagtatagttttatagaatattcatttaccgtcttttttccataattattgaaaaatggattatacttgaataaatcacctcgaaaaatcatatttttttcacaaaatggttcataaacgtcctaaagctctcgtcattttttcttataatagaagatggatggatattcatctttaccaagaaattgtacgataataaactaatcatactcatttgctgatattatatggtagcttgtcttaagtataacgtaagaggtaaatatcaaaacgatatatattttaattgattgattgagaattgtgaaaagggattttcttgcattatctacttgatttttcccttcttttttttataattttgtttctgtgaatttgtatgtagtaacgcacactcattcttttataaaaactgtaatttaaattaacttgcattatcattatgtgaaagtaatgacggaagatcatgatatttgacgttggtttaaaagtataagcttttccttgaagatgtgtcatttgtttgttaaacataaaatcaaaagatacaaaagcaatatatcactaagagttatatttttgcgaaaattctttagttttttctaactaacaagaaataactcgtattcctcttgcctttgcaacaaaatgtacgtcacctgctcgtattgaaatattgtagcatttaaatagatgcatcctacaggaatagttttcaacttataaatatataatgtcgatagcatacaaagattttctcataaattaatgtaggaaagattacaaatagtgtaaaagacagtatttgctacaatatgaatcagattcgcaatttactgcactaaatttaccttcaatctacactctttgacagacctaatcacgaaggcacatacatctcctcaaaacatccttgaaatctgatgcaaagagaaaatatacgtctctctcaaactttataatagaagagaaactatagatcgcatacttgtggaaagaacgggcgagatcaaatcccgaagtccatattatacttattatggttaatgcagttgaccattgctcaacagaaggaatattatttttaatttgagttgattttcgaatcacatttattatacaattttctatatggaagttcagcaataaaaaattattttgtaatttaagatctaaataatttaattacaattttgtccaatgaaaaatgtaccttaaaacggtaaaaaaaactaacgacacttcactaagaactttcgtgcttttatgatatatatattaaaggtacgaaggcccttaaggaaatatcgtttactttttttgcccattaaaaattacgctctaagttggatagaattattctaacaagtttgacgaataaaattaaaagggaggtagtggagttcagtggaatacatattaaaaggtcacctaatttatttgttggtaaatttctgactgaaaacaaaatagtaaaaagaaatattaatacatctaccgatgatcgaaagttaactatataggatcaacaatattatatttatgcaatttttaaaaagaagtgcacgcgtaacgtgtgtcgttcgccttttttaatctttaaaagtatatttatattggacagaatgataattttaattattttcctaatatgtaggaatagttattaattatttttctaatatttagggataatcattaaattaatagctaatattaggactttgatatggaaaatatataattatctttttcttgtaaaactttttgtgtaagagtcctcgacgagcttttttttttttttttgtttaaaaagttttaagtttagtattgtttattttatttttctttttcagaactccttttcttcgtataagttttgtgatttgattatacaatgagatgcaataatttattctttttctaatttgttagaaataattcatataatatttattgcattttattcttgaaaaaaaaatgaacaagggaataacttttcaaaaaagaaaataaaaaaaaatcttaagttttatatttgactactgaaattaaaaagaagtatgataacatatggatttaaagagattgaattaaaaatcaaaataaatttttagttgaatatattgactgatgattcagaactactatgaatattcatcattttaggaaaaattaatatttactttatcactcaacataatattttaatataatatttatataatatttgaaaattcttttttattgagatagtgtacacgcgtaaagcgcatatcataagactagtgtgtacgtgtgtgtatatatatattgattggttgtgctaaatcaactttgatcatcgcatgattgtgttatctcttaatcactattagaattcaaacaataaaatctcaaatgagataattcagtagtccagatgtcaattcgtcacgagttcaaattttaatagtttcacataattgttgatcccaattacggatatattagagctaaaattgttaagggtattctgtaacgatttgaccgataattttgagaatttgtactttgttcgataatttggggcacaagtaactccatatgatatattaaaactcacgtgcaaactttgagtgcactttattaggttctgaatctgaatgaaccagatcttagcctattaggtatctttgtttttttatttttaaaaagtctgaataggcctggttgggtctgattcggccagacctttaattaagtcttaattccgtccagaggtaaaaaataccgaaaatacacgcctcttttctctctctcttgacatcaggctatttcttctaaacccaaaacaaatttcgtctctctcttcaaggatcaagcagccgccgaatctttttctgggtaagattttgaaaattatacttggaattctccatgttttttcgacttttctaatggtaaaaattttagtttcgagtttagggttttttaaaatacgattgagagaaggttttgcttggctcttatttgtgtctggttctcacttttggatattctattttgattgaatctctgaattttctgtaacttttcttctgattttgttgacattccgattctctatttcgtaaatcttaatgtttttttttctcttttgcagattcacattgtcacttttgaacgttcttttagtgattgaaattcaatttctataaaccgtaattggtgtttatgaagctcgtccaaaattaagaaactttgctatggctagaattcggataatgaagttatgtgttgttgaaattagagccgctatagtttcatatttggctagaattcggataatgtatacataagtaagatttaaatttcagttatgtgctattgctcttgaattattcgtcatatgttacatgttttataattgaatcatgctttcttttgtttattcaagaatagctcataccatcaaacatattatttgcttagaaatatacaacttatcttcatgggtggctcaagggtgagactagtaaagctttcgctttgggccccaaaaattttaggccccaaaaagtgttgtaaaatacgtaataatattttgacttggacaatgacttagacaattctgaactttgtagaaaaaagtaggtaatgcattgcaaacatatggctagcatcttactaatttgaattaacacttgataatataaataataattttatcaaagaaaaaatgtattcacatgttgtggcaaacggataacccttcttgtttgtggctctttcctctcgtttgctaagtaattggtatcacaaaagttcttttcttgtgctttcttttttcttttataaaccatagaaaagaaagaaagaaagaagggggaacctgctcagaatttggaaaatctgcagcatttgccttctcagagtctggagatacataccttttgatgcacctaaaacaagattcaaagaaagcaacatatttggattctaaggatttggctacatgaccgttcagatgtatcaaagaaaatccaaattttgcatagaattaaaatcagcactaagaaggagaggagatggaaggggcaggtgttcaatgtttgccttatatgtatttttttgtgatgatggtgttctgtgtgtgttcttgattcctcattgagaatgtcaccatatttttacaggtaaagaagagctttttttggttgtggtctggaacccactgcaaagtaacttatagggcctccgctgttgtatcttacctggtatcgtttccttctcctctttcctgtttaggtagaagtactcagttttaaattagttgttgtaatgctgtgcaattatggttgacaattaggtggtttaaaatgacaatcggttcggaagaggcatcaaaaaaaacttcacgttctcaattggttgtgttgaacagggcattcaaattggtaggtgttcttttcttagactatctaatgatggaagtcagacgtgtataatcggctatatgtccagttttaactttttggactgtaactcttcaagtgtaagatgcataggcactaaagatagaaacatttgatctgtagcatacataaggttctggtttaactggtctaaagtaggagatacaatgacttttatcaggttatgaggcaacggtgtttatctgagaattcttttgtaaaaagggggttagtaaatcaaaagaaagctgggaacttggcactttttcatcccctttttttaataaccgttcatgatttcatagcttcaagttaacttggtactcgtatcatgttactcaactactttccgacaacatattttcttttccctatgtaagtaactggagcaacattcttgaagtcgtctacgtaccttgactggttgtactatttattatccatgttttgttaatgtagactgttgctatggtgtaaatatgtgattcatttgcaggctgagcaatgggttaacaatatgggctcttcagatgatgctaagccaaataatgtggttctagagagtcgtccacctaggtaaaattttattcgacatggttatattttgttgaaattcctggggttaatttcttaggtcgttgtaggcttggaattggtgctgcagttccccgtcaatctcaaactgtactctcaaatgaccctgcggaaagaaaattacgtgctaaattggatgctgagaaaagaaaaaaattgaagagctctgaagcatcaacaatttctaccaaagacgggaaagttgatgaagaaagcgatgacgaggaattagaaagcaaaacgaaagcgtttaccaagaagaggcctgcggctttgccctcgtctctgcaagcaaagaagaagaagaggaagtgactctgcattatctagcaatgaatacttggagatgtgctatagttttcctttagtatattattcgaagccatcatcttcttgttgccattttgcaaggtgcagttctcttgaggtctcagtctccggttgagagaaatgttatgagttctgagtagccctcaaagtggatggtcttgaatttttgtcttcgctcgtcccatgggcaaaactttaacaagtgttgcccctcgcttgctcatggggcaaacggggttcaaaagttatttcgttcgggataaggttatttcggtcctacacgaccccaactcgtataaaaggggttctaaatctaatttggaagagatcaagaattatgtataaaaatatcttcaattgtttaaatattatatttatcaagaattatgtataaaaataatttaagaaaacccctttctaaaaatttatcatcaaatatgtcttttaactatcattagaaaaagaaaaagaactatgataataaaaggaacgagaatggtagaacaaaggaacaaagaattcgggttaaagttacattaggagaaaaaacgaaacaaaaagaaggtaaaacctataccttttaatttgaaggtaaataaatgagacttttcgttgttccagaataatgaattaaataatacaatacaaccaattttaataaaacaatcaaaacaaacattgtttgggaataataatacaatatgatacaatgggtaacaaccatccaaaaaagttgtaaaagtataaaaaaggagaataatattaaaagaaactatagtacaaggactagctaaaacgtcgaatacagttaaacctctctataataacatctctatataacaacacttctctataaaagtcaagttttttcggaaccaatttttatgttatgttataatatatatatgttctctataacaatactttgctataacatccaaaaatatttaaaacaaacgagtatgttatagagaagtttgactgtattatacattagtacaatcaagaaaatatacagattttagagcttagtgtactacttggggaggctagattttaagagaaaaatgatttgaatactaacaaaactataatatcgaaacttaaattaattagttaaatagattctaattatttagttatagtataaggttctaggtataaaattatttagtttctaggttatgtataaaagtagatgacatattgtaatagtacatgatggagaatatagagcgtgtttggctaagtttataagtcggttaaactggtttataagcaccttttgacttatttacgtgtttggtaaacattcaaaatgcttagaagctaaaatcagccataagtcaaaagttagtcacccccaacttatgacttttcatattataagcacttttagtttgaccaacacttttagttattatccttaataatatttctaattcacataatacttttcctaaaataatttcttaactttctcttaattccatatttgttgctaattattttctttaaaaagaatttttttaatttataatcttttgaaaaatattgaagggtattttagtcattttaacaaaagtatagcttatgagcactttttattgaacacatcaacaaattattaccagtttcagcacttctatccaaacacgtaaatgcttattttaaaaatcagtttcagcacttaaaaaaacttttcagcactttaaatttatcagttatttacaatcagctaatccaaacgggctcatagtatgaaataatattcgaaaaccacgttagataaagtagaaccgatcactctttacattacgatatcaaattatatttcaatgaaactacgatataatgtaaggaaacccgtcctcgtgatattttgtgttgttcaaaatttgaacaacgaaaatagatggcgagtgactgatcaaattaaatctgttggtcagtcatctttttgaggttgtcacacctcctttttcaccggtaagggcaataagggagtttttccacttgaagtgacataatcgagtttggtattatttatttgattttcagagtcgccacccggattttttactgtgttctgggacaccatttatttattaaaatcccaaaccgaggaaattttataactctgtttaaaatgactgcgaaccagaaatccgagtaaggaattctgttaacccgggagaaggtgttaggcattcccaagttccgtggttctagcacggtcgcttcatgattagacttggcctaaattgattaattactgcttttaacctatgcacattttatatatttttaccgcttttattattcaatatttaaagaattattttcaagacgggttacatatgcataaacccgtgaaattagacgtgtcgaaattatgtcacgcggacgtgtacataattcacaacactgaatttaataactaaagtcacgtaaatacgtatttgtaaaaaatttcgaaatcacgtcacgcgagcatgtacgtaattcctatagtttttacgaaatctgttcctaaatgtgtctctatgagtgttcattttagtctttagttgtgtcacgtaaaacgtatacacaatttgagaaaaaggtacattttagtcatttttactcaaaattacgcgaacgtatactttgatttttattgcgttttaaattctaaatatactcatcatctaaggaatggatctaagccttcattatatctaaggtaaatttcgaagaactctttagattgtaataggtagccttatgcaaaatcctctaaggctacatttgctagtttaaggatagtatctaggctctatccggatctggcccaattaaccattaacattttaggctaatcctatttttgggctacttaaggtgaaggagttgatttgactaataattatatgagaaattctaggtgcataggaaataaatatgctacctcatttcgaattataaagcaagctggaattacggctataatatcataaaaagacaagtaagatttcactaccatttgacccatttagttagaaaggatatttcatgtacataaacgaatcaaatcacgaatctaaatggccttttcctaaagaaatttttccttgtttcataaatggcactgttaaaacatactttaaaataataaggttttcttgagtcgaaattgcttgatcagttttaggaaaaactttaaaatcaggagaagatatttaagtaataaaaccgggttattactattcttgtttaggaaacaattttaaatttcagctatggtagaatacatccaattagctttgaatccatacgctataaaaaaaatagatttaaagcaggaattttagaaacatagccgggattttcagttttagtaccaagattacgtgaaaactgaagctgctgaagttaatacaattatacagtccattattacagtccaaaacgaaggaaagggaaggaatatagtttgttttacaaaaaataaacttatacatggccattaaagtacaaaaatacaaatttatacataaaatcctacactaaatagttattctaactactgttgcttcagtttcaaacatactgaatttgctcctgactcgagttcatagaatcaaataccacctgattttcggccaataaaacacaatagttatgcattactatattggcaaatttgaccaactggtggtcgaactccacctcttttaaggctttttcatacagagattcacacagaacttagattatggaactattaacacaaaactagaaagcaaacaagtcacaaatatgcactaccatacgtaattggaagttataattaagtcacaaagagatataaaaacagagcagatttaagcaaaatttcattaaaactgagcatagttacataccttaaaatgaaaataacagcagtacactgaccaaataaaggtcaagaaactcctaaactgaagcttaaaaccaacgcagccagacagtcagccaaaccagtagtagaaaacccagaaaaataggacttgaataccagtgaagaaaaccaaatttaagatatttttctttgaattgagatctactatgtatgtgtgtaaatttcctatctttagatttctttttttttttttgcagaatgtttttttcagatattaaagtctaatttttcagatttttggaagctcccttccttcagagaatagggcagtatttataggggttttcggagtagtatcttttgggaaaataccttatctattcaaatatgaaaataatacaactacagctgtccttatcctatttccaacatctttttgtaccagctaggacagctgtatcttttctagaaagttctattgttttacagcccttatcctcttttagaattacagttttaacctaaaaaaaaatctgattttgcttttttccagaattatttctgatttttatcctaattctagaagcttcttgggttgttacacccaagattcctcacttgaaattcctaaactatcctttaatacttttggaattactcctttagtattaaggttgttatttattaaaggttaactaattcttatcctatttaagtaattaacttaattagttaactcttaaaaattagattaactcttggcttaccaagtaattaatctaattattggtctaggcaattgatattaactaactttattctattttggttgattacaaagtagcctaacccttagtgaagttggaggctcaatttttctttaggagaagtggttaattagcttaggttagttacctttagacttaggataattaaaggaatttggttaagttaactaattcaaattatttcaaggagttaactaagctaaattaattttggggttttaatgagtctcatgttaggtcaactattagttaatgaacaacttcattctaaaactaattaactaataactaaacctttattgttaattgactttagattaagttaattactttagattagttaaactaattccttagacttaggttaattacatcaattcatcttatttgaaggattaattagattaagccttgtcttgaggtgtgaactagattagatgaacttagtagacaataattactttttttctaatttagctaatggttaaacccttactattggccaattctagactaattagttaactataagttattcaaaactaacttattagactttggttaattagtcctatggcttcttttatattttagacctaattgaccattcccaataggaattagacaatagttagcctttaaggggttattagcctaagtttcccttgcaaagggtcatcgttaattggattgacctttgattaggttattagttgaaagatttgttaacaaatgtatcttaacttaatctaagttgattcatgaccatcttactggtccatgatcaactactttcctaaattaatcgacaattaatcctaaatggactaacagtctcgaacatgaaacaattagcattccaaagaaataaataaataaataaattctgaattacaacaaacatagttgatcattcagcaataaaccaaagacgagcagaaatcatgtctcggttaaatcatacatggaataattcaaaaccattacttacacatgtaaaatcattcatgaaaacttaacacaaaagcagaatagacaaaaatcagttgattcaagcgagtttctgaactcttacttaattggtgattaatgatattctatgattaacaattaataaaccctacctagtaattgataaggacgattaaatctgaacagggttacatttcaagacatgttaaacaatcaaggatatgcgatgaaagcacatttaacagcctaaaaccagtcacatatgtacaaacggacgaaacagtaacacacatgaaatttaaaaaaaaaaaaaaaacacaaaaagacacaaaggaaagtgtggggtactagtgagagtagtttggatgaattccggtgacttgccagaattttggccggactccggcgggctcaagagtggccttgactggcatgaatcgacggctcttgcgaagagccatcgactcatgtgagtctgagtcacagaatcgaaggacaacgaccttggggttattagggttttggcgatttccagatctgaaataagttaaaatcgagtggtttctggggaaatcgatgttgggagatggttgagggggtgaaggagattaactggtgaaattttggggtcgattggtggtgctccgccgccggtggcgatttccggcggcggagcagggcggggctacggtggatcctggcgaaggttagagagaggagagagacggaggagaggggtacggggtgttagactttaggagggtgagggtatggggggggggcatttggacatttttatagtaaataacaagctagttcccagctgtttgatctgatttgatcaacggctgggattgatttttagtcaaaatggtgtcgttttgggtaagtggatctggacgggtacggggtgaattgggcggtggctttgggtaataaaaagagaattgggcctgggcaagttagcccaggtccgattttagtagtttaaagccaattagcccaaatttaattaatcttaattctagttagatgcaataattgattggctttgcttttgtctaattatcaactaattaaaagtaaaacaatcaattttgatactccaaaaaattagaaagattaaaaccataactatgctagataaactgattaaaatgaccattaatttacattatgtcaattcaactcttttatttactatttagtctaattaattatcaatagtactttgcactcccatgatgataatgatgcacccaattatgtaactttaaatcattaaaaaaaaatttgattctttatccgtcaatgagagccagttgttcataacgacttcgtatccattctgcgtcactaagttcagcctcttgtatgattctcaaagaaggaatttctactcctgcgataatgacggcttgagtaccatagaccagtaaaagacgaattatcattatgcaaaacaatttcacaaatagcacaaattcaacaacatttatttattaaattatttttattaaatttttataggaatatatgttgggttaaaaattacatgctcacagaggtaaaataattttaacttataactaattcaatgtatttggttgtgttgctgtcgccatcgtgccatgtgatgactgatgactgatgactatgacgtttcttcactaattttctggtaaaagttaattgccaaaataaataaataaataaataatcctccttccctgtttttcattcattgatacaatcacaaaaatataaattatatacgtacgtctttcagtccttataaagtttggccaaaaatatttgtcatattagaaaattaagaagtcactacttttttttataattcaacacacttactagtactactccaaaaaaataaaaaaaataattttttttttatatatatatatatattcatcaattacttaatgtataattatatgattttttaaataaatatgctaaaacttaagacgaccaataaagaggatagaaatattataaatggtccaaaattttcttcaagggtgttcaaacttgaaagaagaaaaaaaaatttccgacaacgggtgttcaatacaagttatatgcctctaaaatctaatattttatctatatatataattttttgatacccttagagagcataacttcgcccctgagagtgatcaatacatttttttgaagttttacaagaaaattgatttgaagaaaaagaaagaatttgactgaaactcaccggtcaagttcaaacttacaataatttatgacttagacgtgattacagacagaggcggactcagaattttaagatagtgagatacatgagcgaactgctctatcagtatcatcgttggacttttgatcttaagaattttaatcatatgaacattttttaatatatatccaggatttttacagaatttaataggatcttattatttcttctttaagcatgggtccgcctggtcaccatcattcattgaatcaatgggctctttttcttttctcttgtttcccttaagtttcggataagtctaattttgtccataatatattactttgagtgtatatgatcctttaagtttacagagattgagcacttctgatccaactcatgaaactcctaaaattgatctttaaaactaatggaaacattatataattttgaagttcctaagttatataacgatcgtgatcgggatctacttgcccatcacagttttatgttcattactgatacactttttctattcgattattgtgtgatcagtgtagaattgaaggaaaaaatataattgaagaagagtatctctgttgggattattttttcctctagtcacgtgaaaagcatgagaaatattcattagctttaatgttgtcaattagattagtatgtgacatcaggaaacggcaataaacaatacaatttatccaaacaatacaatacaatatagtaaaatacaataaaatacacattatgaaacgacatgtaataacaatccaaacaagctgtaaacgtgcttgattttttgcaaacttaaagaaccatatatgctcaagtaatataatagagactaaactagacttaccctcaaatttcagggaccatatgtgttaaaaactcttattaaatccataagaaaaaaaacagaaagagaaagacagataatactctaatattctagctctatttccagcagataatccaactttgaacatgcattaatgttgtcataatacacatagttgactattttctgctgtgtgtatagtataaaataaaaatatctttcatcttcatacatcttgtcctttccattgcattcttacctgaacttaattctctggaccaaattctaagaaatggctactagctatgtctggtggtggagctggtggttcatggtggttgttatcggttgtttatcgatccagaagccggttttttccgagccacaaaccaacctgttaggcaaaggatgtagtcaatacaatgcaacaaatttacctgattttttcagaagacttaatgcaagttttgatgatttaaggaaccagttgtctaatcaagataagcgattcgccacgagacaacaggctgtttaagctatggttgaatgcagaaaatatttgtcaaaagctgattgtgtctcctgttatgatactgctgttactataatcagaacttgctctggtgctaatggtgctcgtgttacctatgatggttgcttcctcgggtgagttacacctcgatactagttggagtcgactatattaagaaatctctatagaattgctcttagtattttcacatcaaattttcaagattctggcctctttttcaaaatctccactaagaaagaaactaaaaaaaaaggcaacccggtgcactaaactcccgctatgcgcggggtccagggaagggccggaccataagaatctattgtacgcagccttaccttgcattgctgcaagaggctgttccacggcttgaacccgtgatctcccggtcacatgacaacaactttatcaattacgccaaggctcccctcaagaaagaaactaaaacaaatatattaaatgatatgcggcagcccttgattatgataattaatatgatgttgtttgctaacattcaagagtcaagattattggtaacagcaatatttatattactgtttgattgcatgcaatccctaatactaacctataaacagtctctcagttgtttggtatagagatcatgtaacttcttgtggtaatcttcgattcagataaaatcgtcaattaaactcaaaaactgtggaaagttgaacttttccataccttttagcctgtaatgtgaagaccagtttctgaggcagtctattttctcagggggaaacacaaacacttagatagtctaatttccaattattaaatcatactcattaaaatggctgcttgtattagaatgtaaagataaaaagggggagtaaaatttcttctaataacttacatgaactcattgctctactgatgcctttttccaaaggtacgagagcaacaccttctaccaagagactacacttccaggaaatgcagcaatttgtgggaatcgaacagcttctcggccaaatgctttaaatcctgtggctcaacaactcttgaatgatcttagcatggcgactccaagaattagcggcttctatgaagccacaaaaagagaagtcgctggtgttactctctatggagtagcacaatgtgccgaagccatcactaaaagtggctgccaagattgtttgacagtggcatataaaaacatagaaggctgcttgcctaaatatgcagaaggaagagtgtagatgcagcctgttctatgaggtactcaaatagaacctttttcgctgataataaaacaactgatatcacaccattctggggaaggaggtaggaaatgaagctcgctttcctcaactcttaccagctatgttgcgcggactctccaaaatgttgccgtacccatgtcggatcctccaaaaatacactacttttggaggatccgacacgcacccggtgacattttcggagtgtcctagcaacatagcttaccagtatttattcattttaagactgaattaataattggggggggggggggtgctttatgcaggaagctcaaacaagaagaaagccgccatcattgggggtatcgttggaggtgtaggacttcttttgattgtatcggctgtgttcctatggtatcgactatcaagaaaaccaaaggcaactgaaagaggtaatatttgatgatctttttctcaattaagtagtaaccaatatagtagctcttttcatttgtcctttcatttatttaagtagcatatgatatggtatctactgttcaggtaatatagtgggagcaactgagctgagaggtccaatgagctacagatttaaggacctaaaaattgctacccaagatttcgatgaaagtaataaacttggcgaaggcggttttggtgattttacaaggtacgttaatactgaaacagttgaagatccttatctcaatcaaattgactagataatcttgatctgacttctattcatttatccacttaatttaattgatatgatgattttaattattgaacaaggcactttgagaaatggacatgtagttgcggttaaaaaactagcaattttttcaagcagagcaaaagcagattttgagactgaagttcagcttatcagcaatgtacatcatcgcaatctcattcgtctcttgggatgttctaacaaaggagcagacctactacttgtttacgagtacatggcaaatggcagtctcaagagattcccgcttactatttttgtccaagtcaaatcattatgttcaagtaaatttgaaataatcttacctgtcaatgtttttgccggcgacaaacgagggatgctcaactggaagcaacgatttgatataatctttggcatagctcgtggccttgtctacctgcacgagcaattccacgtctgcatcatccatagagatataaaatccagcaatattctactagacgatgaatttcagccaaaaattgctgattttgggcttgtaagacttttacctgaggatcagagtcatgtcagcactcagtttgctggtaccttgtaagtcaatttgactgctcgagtttcttatctgatatcactaaaagcattatgagaacaactcgatgaactctaattgaaacaggggatatactacaccagaatatgcaattcatggacatctaacagagaaagtcgacgtctatagctttggagttgtcgttcttgaaataatcagtggccggaggagcaatgatatgcaaattgagcctgtcactgaatatctccttgaaaaggtctgttttcattttcaaattccacttttcctttcatatgttactaagtattctcttccaacttctctgtcccattctaaatgtacctgtgctatggtgaaaataggcgtggaaacttcatgaaactgccatgccagaaaaattggtggatgagactttagaccccaatgaatacaatgaacaagaagcgaagaaaaatcgtagagattgccttaatgtgtacacaatcaccagcaaatcttaggcgaaccatgtctgaagttgttgtcatgctattaagtgatcatagcacagacgccgcgaactcctagcagacctactgtcttagcatggataagagtacaccagcggactcatccattactactggatcttcagcttctaatgcagcaagtactttttctgatttcactggccgctagctacataagattatacgatagacctgaaaattatgctggcaccacagcatctgaaaaaacatggaaagtatgctacagtgcaaaatgaccactatttaagttattcaagtcttagtttttcatggttcatatccgtgactgactatgcaaagtagaactccatcatcattgcagaagcaatgagaaatttgctgtcttcactgttagagtgtcttattaaatgatgagcttgaactcgactccgtacaaaataaaattcaacctcaattctttgatgtagaaaatgcaattttgtaaatcttctgcgtatactaatactcaaatttcaaagtgatatcacaatcttccacgtggcaacaaataacaatgcagtatggtgattgtgtactgctgttgatatcgtcgaagaataactagttaagctcaaagctagacttctgtataaaaaataaacaaggtaagttcaaggcataaagtatgcatagggaaaacgtactcttatctctcttaacaacagaccgagtaggggaaggggggggggggggggaggggggacttttaagtgaaaataaccatcgcaaaatcatcttggcatataaagtctatttgatttactccttaattattttgaagaattttggtatttccttaatgtggctcgtagaggagaataaaaaaggaactatttgttaaaaacataataaaataaataaaattgtatcatctctagctgtttaagcttttggatgagatggtcaaataattcaatataatattaagcagacagagatccaccacccattatcaaaaagaattttcagatactgggtccataagaagaatctgccccgcacatgagagagtgtattgaagacataattaagtacaaataaaagtgtctcctctctaacatcttttagaggttttacccggcggaaggtaatgtggattgtgtatttcttccatatagagctatattctgggttcacaaactcttttcaatttgtaaaaaggaaaacaaagaactacatcttttcagcaagatgttcaattctcatacaaatgaaataaatgtgatttaaaagaaccaatattttcctgttcggtacatagctcagaaaaaagatcttaaagggattatttacagaataacaactatgagaatcaccagtaatcattgcaagagcatatccctttgtcaaaatggtggaaccgatttgtatctctaactataatctttcttctcgtcatttctgacacaaacttcatccaagagtgacaatccgcacaaattcgaagattttttgtcaccctaattggaataccagaaccagtatgaatcagaccaaatactgtagcaagccgttcactgtgcccacatatccattctgcttttgtttcctcgtttacatcatgaagcacaactctcgtatcaggtttataccccattttctcaatagcttctgataattcatcccaaacttccttgtattcatctgaattacgaaattcaaaaccgccaccagccataaatgtgtgtactctatttctaacctgtatccagctgcatccggcttcctttttgattcccttattttccatcatctccctcacttttttaactccctcccacattcctgcatttgcataaatgtttgatagtatcacgtaatttccacagttgttaggttccatctcaaatagctgctctgccacaagttctgcaagagagacatttccgtgaagtctgcatgaattgagcagtgagccccaaatgcttccactaggcttgacgggcattttctccactacttgcagtgcctctttaattttcccagctctacctaataaatccacaagacaagcataatgctctgaggacggacgaattccaaaatctccactcatgctttcaaacaattcctcgcctaagtccgccaacccagcatggctacagccagacaacaaggtgataaatgtcaccccatccggcctaactccactactgaccatatcatcaaacaacttcattgcttcattcatcaaaccattgattgcatacccattgataacagtattccatgatgttatgtccttgtacttcattttctcaaatactcttctgcaatactccatagctccacatttcgcatacatatccaaaagcgagtttaataaaacaagatcaggaactttagttgatttaacaatttgagagtgtagctctctcccataataaaggtaagtaacctgagaacagacagctaaaattgtagtaaaagttacccaactatatcccactccatctttttgcattctcctaaaagtctcaaatgcctcaaaaacctgtcctttcttaacaaaccccgcgatcaacgaattccaacttacaacatttctctcaggcatttcctcaacaccttcaacacatctcaaacacccccacactcactatacattcccaaaatagcattgtacacaacttgatcaggttctttattacccttaacaatctgtgcatgaacacctctaccgatcctcaaatctgaaagtcccgaacaagctttcacagccatagaaaaagcaaaattccccggttcaatggacttaaacaacatttcacaataaatcaataatgcttccctaaaaaacccttttttagaatacccaattgccattgcaacccaaactgattcgggctggtccttgttttcaaccccgtggtgctcgaaaacacgacgagcttcatctagctgatcacaaacagagaaaaggacaattaacttagataaaattaaagggtcattgagaaatttacttctgtttggatttaaaagaaggtgaagatacagcctgtgaccatgttctaatgatttctgtgaaatgcatgcatggaggagatttaaataagattctttattttcgggttgagaatttttttgggattctaataggagaagagcatcgtttagttttccggatttagtgagggatttgagatttgtgttgaagggttttggaggagttttgttaagcttgttgaagcttgaagtggctgttatggtggttgtgacagttggtagagaaatggcgggaaatcgccaattggtgtcttctgaaaagttcgtttaccctatagtttggtgataaatgtttggggtcttttctttaaataataattaacagaattttgatagggaagaaaatatttcttaggttgggaaatattaattttattagttactctcttcgctccataataaataattttttaactttttttttgtggtctaaaataagtgatttttcagattttaaaaataaattaattattttttttcttacattgtcgttggagtaaatatcaacaacaagctaggaaaatgaaaccaacaatgtatgtaccgaaaaaacagatggaagaaagcaatagcaatagccaagtattgttatttctctgtatttgtacaacaattctggataaaataaataacataaacagaaatgcaaatgaaataataaacaccaattcgagcccactgaattgacagtgtttccttaaggaatttaatcccctcctagtacccaaggttatgaattatttcctcccaggatagaacggattacacactggtgtagtggtacttcaaaccccagtgtttcagcgaacacaaagttcggtagtaaatcacacttactgttgctttctttgaagtaataatatgcagaaggaaggaggagaactcagaaattagtatgtaaaatctgagagaataggcttgtatttatagccaaagttgggctggaatttgaagaggctgtttttgcaaaatgcccatagaataaatgacatgacagctatttactcaacaataaagaggaaaaattgaaggtagttaattttctattgcaacaacagaaaactgaaaattgaatacttgaaatggatttaatattaatattttattattaaacaaatatttaataatatttctgttaatatttaatgtccaaaaattaatcaatcgatcatttgaccgaagccgagcgagcgacgacgacaacgacgcgaggcttgccttcttctcaactctttaagagttagaagtaaagcaattgcttgtatacccatcaaaaaccttttcctcttcccatatgggacaatcaaggagggaacctcaaatattactcaaatattttatttttccctccatttctcattcgccctattttaagcttattaatgcttaaaaacccaacagcagtaacaacgacaagatactatagaaaatcgaagcgtaagatagtactaaaaatcaccctaatactagcactctgataaacaatgacaggtactaacagactagccctaataaagccgaaacaatacaggaaaacacactacgacctattaccataccaccataatcttcgacatccaaactcttttgtcaagggccgaaatattaagttcacgtgaacccatatattgcatgatagatataccttagggattaaatgcttctagattggtaaataatgaattttggtatcactaaataatatataagcctcgacaattaaaattatttttgctgttaatttattaaatcacagtgctatctttttaagcaaagtaattaaagataattgttgcgactaggagggaagcacaacgtgattaattaacaaattattcataaataaataaaattattgtctagtactcaacattaatgataacctatagtgtgcaatcaaaataatttccaataaatatttttcagacactgcttttttcttatacaataacataataacaacaactcagtaaaatctcaccagtaggttatgggcaggatagagtgtacatagaccttaccctacctcggaggtggtagagaggttgtttcgggaagacactcggctcagaaacaatagatctgtgacaacataacccgaaaaataatatcggcaacacgagatataacaaataaatagaaaaacagtaccacaaatatcatgcagaagtgtgaaacacaacataaattactagcaatgctagacaaaacactatcatactcgccggcacgatatatcttatacaataggtactccaattactatatatcttcattactcgtggaaaaataataattaagaacgtgtattgtataatataatatattaagggggaaaagagaactttaagatgcatgtaaataattaaatgaatataattatcaattttggggggaaattaaaatagttaattttcttgctcatatagtcaatggatctggtcatcatttatttatagtagtaagtatacttacttattttgttaagattatttagttccattattagtttaattttaatttttaattttttaattacctaataagccataagttccattattagtttggttataaaaaatcccaccttaacaacttttcaaatttcataaaaatccacatttaaaatagaaaaaagaagatcgaggtgctcactaaatagatatattatgtgcaaattctgacatcgccacaaaaaatttgtttattccgcttcttggttgtaaagcggtaaatctaaaatttcaaatataagaaatataaacgacgaaataaaaaataaaactttacgattaatatacgaaagtgcccctcccctttttcccatggattttctcctcttttcatctttattttttaaataagcatattacatgattttcaaaaatttttaaaattcatcttcaagtgaaaatttgaatatttatggctaaatactaatttcggaaaaagtaaaattattttgaaaaaaataaaaattttcttatgataaagtaaaatgatttttttaaatagttttctaaagtaagctggtcattaattgtgacacttaccaagggaaggaagacaaaagatagtaataaaagtgaactctttctatattttatttgaaatatcatgaagatcaaattacttaagtttttgaagtaaacttagatataaattatttatacttctgaaataaattttatatgttttgaatattatatcataagtagtaatactgaacaattaaaaatattttacaaaatataatttcacatagagtaaaataacgcgagtttaatttttgaattctgattccccgaccaaaaaattattaacaacaagtacactatttcctccggtctaaaataagtgattttttgattgttttcacacatattaagaaattcaccgtttaacattaattaacaatgaaattgactatattaacttttactatcttttcacatacacactcctaacatatactccaacgtcatttactcaaagggcaatgtaggaaaaaaataattaattcattcttgaaatatgaaaaaatcacttatttcggacaaaaaaaaaataaaaaaatcacttattttggagcggagggagtaacttataatattgaatattttaagtggcacaattatttgtttaattaatcaccccattaattaggagaaaaaataatcacccatcattagttttattattattaaaaacccccaccttaacaactttccaaaaaaaatttttgtaataatttcacatacacatttccaaaaataccctttcctctactacccctagattttctcccctttctttctccctactgtcttaacatccatcatattcggatctacctgtgacccgaatccattttagtcaatatctttcttcttcatctgaagcttctctcagcttccactgtttgttcatggcgtcattttcaatcgttgaaattcaaatataataaaaaacatagttagtaagcaaccccttttagattcttaagcttaaagtaacattctttgttttttctctttgattaaacccttttaacttctcaccaaacaatttccccaactaacgctttttctcttcaaaaatcttaaagaccactcttttcttcataaaaattcaggattcttcaagatcttgacacccttttgaattttatagtgaaaaaaatgaaacagttagcggcgttacaacaaggtcgccggagcaacagctttagagggccgttagattcgccgtcagatgggtctgttaagtctccggcgactattttctggcttgtgcttcatggggtttgctgtttgatcagtttagttctgggtttcaggttttcacgcttagtgttcttccttttgttcactaataatagctcatcgtcagctccaaacagtgttttgtttcatgatccggctaggatgacatcattttccggtaatggcacggcggggacagcggcggaggttgcggtggtgaggggagtagtagtagtagggtggtggtggggaggcacgggatattaatacggccgtggccccacccgaatgctactgaggtgatgcaggcacataagataatggagatagttcaaagggaacagaagttgcagtatggtgttaagagtccgagggatgtgattgttgtgacaccaacatatgtgaggacttttcagactttgcatcttactggtgtgatgcattctttaatgaatgtgccttataatgttgtgtggattgtggtggaagctggaggagcaactaatgagaccgcctcgttgatagctaaatcaggtttgaagaatactattcacattggattacgcgagaagatgccacttttcgtgggaagatcgccataaattggaggcgaaaatgagacttcgcgctttgaggtaatgggagtttgtttctacttaatagctgtttatgtttaacacctgcatccgcggatgtagccttagtgctgtggttcaatcgaacgcagtattattacacgaagcatagatgtatatgtgaagaaaggacagaatttcaacaaaattttgattcaaaactcatatttttagaagtatagtgaggtaagtgctaagaattttaaaagttgaatccatcaagttaaaatctttgatcagcctctgaacacctatattgtgttttatgtatgtggtaaagaataaacttagaacacttcttgcttcatcaaacgaataactttagaattgtaacatgatagtgtggtttgtgtttgtttgatggaacagatatgtgagagaagagaagttggacgggatagtgatatttgctgatgacagtaatatgcatagcttagagatttttgatgagatccaaaaagtgaaatggattggcgctctgtcagtgggcattcttgctcattcgggtggttctgaggaggagttgtcgacagttcagaaagaggaagagaggaatttgcaattgcctgttcaaggtcccgcttgtaattcatcagaccatcttgttggttggcacacttttgattcgccccctacttggagaagagtgccagattcattggtgatagggcagttgtgctgccaaggaagcttgaatgggctggctttgtgttgaattccagattggtctggaaagatgcggaagataagcctgaatgggttaaggatttggatgctgtaatggggaaagggaggatgttgagaaccctttatctttactgaaggatccttcaatggtggagcctctcggaagttgtgggcgcaaaattatgctgtggtggctccgcgttgaagcacgggcagacagcaaattccctgccaggttagttgtctagcgctatcttgaatgaatgtagcatcgttttttgaatattcttaccattgaatattatgtttgttgtttctatctaacatttctttatcattcttttgtaacttttgatcacctagccataattgtggttgtttcaagattgtcatatgttcttaaaacatgacaaatcctcgtaggttgccttatctgttttcattttctttttgaatgttcttagggtgccatatttgttgcatataattaagaccaaagccatgaaacaacaggagaaataagattgatatcagaaaaactcaataaagttaggagctaatagtaataggatgaattttgatatgtaaagagtagtactatgattttttttgtatattccttcccttcccttcgtccttatctttgattagtaaggataagagtctttctattaatgatcgccaaatccttcctgttgtaataaggtgatttgcacacaggaaaagttgtcaagtgggttcaaacatatcaagaggtcatgtgatccccttactgatcagttggtttcatggcttgggttgctcttggtaaaatctggtcaaacatcgttgtttgttccactaggtttgtctttgtatgttgtcttcatgctgccgtggggcttcagcataaagcacttccttcaatgaatatcccaagagtgggttattttattgtttgatgttcatgatttaatctaagttgcttggacttgggtggggtgtgggtgtctgatacatgtcagatctagaggttggatccttcagaatctaaattttaagattcggagtgacaaatccgggtaaagagattcggctaaaaattcaaatatctaaactagagttataaaaatatgtctaaattatgagatatcatgtgaaggacttacaaggtataccgagaaggagaaaatattgatctagaggaaatccgagaaggagaaaatattgatctagaggaaatccgagaaggagataaaaaggaaaaggactgacgtagaaatctttttatacaaggtatcccattttcttcaatttcaccctagctattgttttgatttcagaaatcattctatatgtccttaatttctccgtcgattttggtttaagtacccaaaatggtttgaccaaatccaatgtggatctcacacccacacccacacctctatcgtgtcgttacgggtgcggcaccaaaggtgaggagtccgagcaacttaggatttaattgatacttattccgggaaatgattgaattttagcaatgactcaggagagtcggtgttttcttggttaccgcaaatggcttctctttcctaagctcaattgctccaattgcaagacttacattaatgaaaacattccgacgattctttcctgaaattgttgatcttttattagagaaatctagtagctacttttttgccttttctttggcaatagcaatacactgaatagcttattacatgttagcagattgattcagttttgatctcactgtgctagagatcaattttgaaggtgggatagaaaaaggtgacccaagtttgatagaattgggtccttgaattagttcttgtcgtaacaatttctgccttccactcaataatgtttgtgacagttaaatggtagttgtgttggtcttagttcaactacaatgactgttgggttgactaggtaacaacggtgcggaggtagggttatttaggcttaaatatagtttacgtttatttgtgcgatggagtctagctactttgatatcttctattctatttatgcttttcagcattagattgattatatccctcatatttccatctgtatcgtgttattcatgaagtttgagtttaacttttaagttcatgggtggttaattttggatcagaaagtttaatttgataataaagatgaaaaggtgtgagttgcattttaaatagctctgattatttcttttatatttaatttatcatctgcttggtctcttcctgatctatttcgcttgagtaagaaggtgaatcacatctgggaggaaatctttgtagatgttgagctatattttcttttgaactcattaaaaaaaagaagccagtgttgaactcgttgcatattccagaagtgtggctatttgttagctctatcaagcattcggtgcccaactttgccaattatataccctaataatcttctctgattctgaagtatcaaatataatataatgtatactcatagtgcatttcatgttacatgtgcttcgtaaaccatactagtattgatgaaagcaggatatctgtgttagatgctgtctagacaaagatagttttgaagctttcagtaatgtcattaacaaacatgctcgttagtatcaaagatgacataatcctactaaaacattacatttcattttaaaatttgcttcatactagcgtatagacgaaagcaggaaacctgtgttagatgctatcaatgggtagcttcaaagctttcagtaatgtcattaacaaacctgttttgttaacttgaaacctagaacgaagagcttcgagttaaaagtttaactttgattagtcgaacattggatgatgaatgtgtggaataagatatactcctgaagacgagttgttactacttgttcgatttcttttcttgatcagctttgcaatatgtgctttcttcgcgttagggagtatgagagaagacgagaagaatattctgaaatgagacatttacaaggaaaactataataacataagggagcagttagcactaggtagactacatatacagcaaacaggaaattgaggaaaagagagaaaattttgaggtgtaaggtatgtttgatttgttaagtaggactttgatgagggagcgagcgcacaagctatatgttgctaaatgatgaagaagacttcaaaagttataagccttggtatggttgatcttggaaacttttttttgatgaagtaagagaattgcattaaaggcatcaagaagatgcaagaagtacaaaagagagatacataaagacatagtcagctctacagacaaaaactaggctaaagcgaaggagctgacgaagtccaaaagattaatagggcaattgacaggagctatgttctgccaactgtataaccataaaagacatctagccttgagtgcgtatgtaggagttgatatcccatcaaaaatctactattcctttctgtccgaacacaccacaaaatacaagaacggatcatctgccagactttactgatggattcatcaactttccatgaagaccagctttcatacgtgtccttaatgttctgcagtattgtcaaaggcgcacttaagccttgaagcgaggctcaaaacatgttgagcgctttgcctcattttgtgggtgctttagtatcggatcaaggctcaaaggcatactattccttgccgatgagtgtagcgacattaaacaattgatatttcactttatcgtaatttttttttaatttctttgtccatatatttgttattcgtgcttataattattagtcttggactacatatttttactttttctctagttgcgccttttttcattaaagcccacactttatttgcgcttaaagccccaacggagcttagagctttttgctcttttcgcatttgataacactgatgttctgaggcatgacccagcttaaaccaatggttgttcttggaaactagctcaaatataagttctgcacttgcccattctcatgaaattacataaatggggcataattttgttgtctgtgcatattttcccctaaatattgtagttgatcaacccaattactacgcatgtgctttgattatattgcataagctagacatattggttgctttcactcgaatgcagtatgactaattcctaaccaaaatgcagatggatcatcgatcctccactagatgtgactgtcccagcaaaacgaacgccatggccagatgctcctccagagctccccctcggtgaaaagttggtcaccatgcaagagcacactgagaagcgccaccaaaaacacgatcaagaaaacatagttctcggagcaagagaaagcatgtagcaaagaacatggacgaccgtcatttggccaggcaagatgcggagaactagcgaaccatctgcgaattcagcaagttcgaagacctatccttgtctcgtaaataggagaaggcatttcttacagagaaggcatttcttacaatagcaattaatacatactacctgtccttttattcaattatatcttgtattcttttccacttctttttacccaatcttcatcaatttcttttctgtcctattttggtctttagtcttttgtgtaattgaattgatgctcagttagaagggtgtttttgttgttgttgtcactgttaccagactcctttttttttttggccaaaggttgtatttgtggcttggagtttatatatgtaaaatgacaacatctagagatgagaaatttatgcccaaatcttggtttttctttttcatttcgtggacattgtttatttctgtgctcatgtcaaccaaatcctttaaaaccctaaaggatcgtaacttcgtgccatggccattggttttattggtattaaaggtagggcaacgattatttgtagttagcgaccgaaactatttatatctattagtcgtaaaatttgtatatttttttaagcatgtataagtgtatatatatacaaatatatatatttgttcggctgttattttgagagcgaatatataatgtcatttttctttaaaggtactttggttagctaacaatggggcttcaccatgaccgtttctttttttatttggtgttttagggccataaaataggattcaggacgattcccagattttcgtatgctatagtccacgtcatctgcatgaattcgggcgactgaccctgaatctccaaaaattttgcggaccgataaaaacgacgtaatgaataatagtcatcgcttcgccatgaccgttccccatttttggcattttagggccataagagaaaaatataggatgattctcagatttttatgtattatagtccacgtaatctgcatgaattagggcaaccggtcccaaatctcctaaaatattgcgggtctataaaaagacctaatgaacaatattcatcgattcgccatgcctttcctcgttgttggcgttttagggccacaaaataggattcatgacgattacgagatttttatgtgctaaagccacgacatctacataaattcgggcgaccggcgccgaatctcctaaaactttgcggacccatagaaaatgaccaaatgaacaatagttatagcttcgccatgactgttccttgtttggcgttttgggtcatatagtaggaattcaggacgattcccaaattttcgtgtgctatagtctacgacatctgcatgaattcgggcgatcaactacgaatctcctaaattatgcaggatcataaaaaaataatctaatgaacaatacccatcgcttttccatgaacgttccacattttttggcgttttagggccataaattaggaattcagaatgacacctagatattcgtgtgctatagtccacgtcatctgtatgaattcgggtgaccggcctcgaatctcctaaaattttgtggccataaaaaacaacctaacaaacaatagtcattacttcgcgtgaccgttcctcgttttttgcattttagggcataaaacaggaattcaggatgattcccaaattttctgtactatagtccatgccatttgcatgaacgcgacctactacgaatctccgagtattttgcggttccatagaaaatgacctaatgaacaatagtatcagtttgcaatggccattcttttttttttttttttataatcattttgggtcataaaacaagaacttaagacgattcccatttcatgtgcaatagttgacaccatctgcattaattcgggtgacctgccctgaatctcctaaaattttatgggcccataaaaatgatctaatgaataatattcatcgcttcaccatgaccgtttctcattttttggcatttcagacccacgaaaaaggaattcaatacgattctcaaattttcatgtgccatagttgacgccatctgcatgaatttgggtgactgtccccgaatatcccaaaattttgtggacccaaaaaaataacctaatgaacaatagtcatcgcttcaccatgaccgctcctcgtttttggcgttttagggctataaaataggaattcggacaattcctagatttttttgtataatagttcacgccatctgcatgaatttgggtgcccatgaaccgtatcgcgtaaaattttcccgacccatcaaaaatttcctaaggaacaatagtcaccgccttgccatgaccgttactcattatctggcgttttagggccaaaaattggaattccattcaattcccaaattattgtgtgctatagcccacgccttcagcatgggcctgggcgatcgaacccggatcgcctaaatatttcagactcatcaacaatgacctaggaaacaatagtcaccgtctttccatgaccgttactcgtttgttggcgtgttaagaccataaaattgaaattcatcccaatttcccgattttcctgtgctatgtccgatcgcctaaaagtttaccggcctatcaaaaaagacctaaaaacaatagtcatttcccattcatgaccgttactcattttctggcgttttagggccataaaactagaattccgcccgattcttaaatttttgtgtactataaccaatgctttatgcatgggccaggatgacccattcagattgcttaaaattttatcggcccttagaaaactacctaaggaacaatagtcatcgtctcctaaggaacaataatcaccgcctcatcatgaccattactcattttttggcgttttagtgcgataaaacgaaacttccactcgattcccaaattttcgtattttcgtatgctatagcccacgccttctgtatggggctaggcgaccgggacccaaatcgcctaaaatattatcgcccataaaaaatgacctaaggaataatagtcatagccgcctaaggaacaatagccaccgcctcaccacgaccgttagttgttttttggcatttttggaccataaaactgaaattccgtccgattcctagaatttcatgtaccatagccatcaacttatgcatggccaaggcaaccagacccggatggcctaaaattttaccggcccataaaaaatgacgtaaaggaacaatagtcaccgcctcgccatgactgttactcaattttggcgttttagttaggcctgttcatttggatcgatatccgaaatccgaacagatccgctcaatttcggatttcaaatatttggatcggatttcagattgtgtttattaaaatttcggatattcggatcggatttggataggtataattgtaacttgatccgatccgaaatctgaaattattagggcatttataaatgttaaactttaatttcagatagttagtacttcctttacatcttcctccaagttattacctttacaattactggatttagctatattgacaccatagtactctcataattgaataaatatgattttttcttactgtattgcctcttttatacagaaaatatatatatgagtttgcaactttgaggcataataatccgaattcaaaaattcgatccgatccaaacattaaaatccgatccaatccttattaattcagatcggattcggattgcgatttgtagaatccgaaatccgaatccgaaatattctaaatccaatccaatccgatccaatccatgcacaaccctagttttagtgctataaaattggaattcggcccaattctaaggtttcatgtgtaatagcccatgcctttatcattagtccgagcgaccgaacatagatcgcctaaaatgttgcaggcccataaaaatttacttaaggaacaatagccaccacctcactatgaccgttactcgttttgggcgttataaagccataaaattggaattcgtccagattctcaaatatcatgtgctatagcccatgccttcagcatgggcccgggcaacaagactcggatcgcctaaaaattttctagcccatcataaatgacctaagaaactatagtcaccgtctcgctttgactgttactcactttttggcattttaggacaataaaattgaaatttcgcccgattctccgattttcgtgtgttatagcccatgccttctacatgggtctgggtggccggacctgaatcgcctataagtttgccggcccataagaaattacctaaggaacaatagtcacacctcacaatgaccgttactccttttctgcgttttagggccataaaactggaattccgcctgattccttgattttcgtgtgttatagcccacgcattctatatgaggcccggctcgcctaaatttttttcagctcatcaaaatgacctaagaaaaatagtcatcgccctctccattaccgttagtcgttttttggcgtgttaaggccataaatttaaaattctgcctgattctcctattttcgtgtgctataaaccacgccttgtgcatggggccagacgaccgaagcggatcacctataattttgccgtcctatcaaaaatgacctaaggaacaatagtcaccgcctctccatgactagtactcatttttttttttttgcattttagggccaaaaaacttaaacttcgctcggttcccagattgtcgtgtgttatagcccacaccttcggcatggcccgagcgaccagacccagctcacctaaaatttttctgtcccatcaaaaatgacttaagaaacaatattcaccgctcgccatgaccgttactcattttttgacgttttagggccttaaaagtggaattccgcacaattcacagatttttgtttgttataactcaccttttgcatgggcccgggtgatcggaccctgatcacttaaatatttttggcccataaaaatggcctaaggaacaatattcaccgcttcgccatgaccattaccgttttctttggtattttaggccataaaactgaaattccgtccgatttccagattttcatgtgctattgcccacgccttctgcatgggccgcacgccggacctggatcgcctaaaacattttttggcccttaaaaatgacctaaagaacaatagtcatcgcctgccatgaccgcaacttatttttggttttttagggccatagaactataattccactcaattctgagattttcgtgggctataggccacgcattctatatgggcccgggcgaccggacccgcgctctctaaaaattttgtcggcccgtcaaaatgacttaaagaacaatagtcaccgcctcgccatgaccgttactcattttttgggtgttttagggccattaacttgaagtttcaccgattcccagattttcgtgtgctataacccacgccttcagtatgggccatgcgactggacctggatcgcctaaaattttgccggcccatcgaaagtgatctaacaaacaatagttatcgcgtctccatgaccgttactcgttttgtggcgatttagggtcataaaactgaaattctgcttgattccaagatttttgtgtgtattagcccacgccttcggcgtaggcacggagtgaccagaccggatcacctaaaatttaaccggcccatcaataacgacctaagaaacaatagtcaccaactcgctatgaccgtaactccttttttatcgttttagggccataaaattggagtgttaccaattcccaaattttcatgtgctatagcccacgccttctgcatgggtaaggacgaccgaacccagaccgcttaaaagtttgccgccccatcaaaaacgacctaaggaacaataatcactaccgcctaaggaacaattgccaccgcctcgccatgaccgttactcgttctttggcgttttaggatcataaaactaaaattccgccctatttccagattttatgtgctatagcccacaccttctgcataagccgggggaccgggcctggatcgcctaaaatattgccggcccatcaaaaaacgacctaaggaataatagtcaccgccgcctaaggaatattagccaccatctcgccatgatcgttactcgttttttggcattttggggccataaaaatgaaattttgtccaattcccgaaatttcatgtggtatagcccacgacttttgcatgggcctgggcgaccggacctagatcgcctaaaattttgccgatctacaaaaaagacataaggaacaacagtcactgcctcaccatgattgttactctcttttttggcgttttagggccatcaaactggaattccgcctgattaccagattttcgtgtgctatagcccatgccttctatatgggcccgactgacagggcccggatcacctaaaaacttttcggcccatcaaaaatgacctaaagaacaatagtcaccgctttaccatgatcattacttatattttggcgttttaggaccataaaattggaattcctcctgattcccaaattttcgcgtgctatagctcacaacttctacatgggccaaggcgaccagaccagaatcgcttaaaattttacctgcccatcaaagatgactaaggaacaataattaccgcctcgccttgaatgctgctcgtttttgtcgttttagggctataaaactggaattccgctcgattctcaattttcgtgtgtttagcccacaccttctgaatgggcccgggcgactggacctggatcacctaaaattttgtcggtctatcaaataaaacctttggaatgatagtcaacgcctcgccatgaccgtaactaatttgtttggcattttttggccataaaactggaatttttccacattccgatattttcatgtgccatagcacacgccttctacatgggcctgggtgactagacctggattgtctaaaatttttttgcccattacaaatgaccttagtaacaatagtcacttcctcgccatgaccattactcattttttggcagtttagggctatataaacaagaatttcgtccaattctcagattttcgtatgttatagcccacacttctacatgggtccgggtgaccggacctggatcgcctaaaattttaccggcccgtaaaaaagacttgaggaacaatagtaacctcctcgccatgatagttatttttgggcattttaggcccataaaactagaatttcgcccaatttccagattttgtgtgtatatctacgacttcggcttgcacccaagcgaccggacgcagatcgcctaaagttttagcggcccataaaaatgacctaaggaacaaatatcgcatcgccatgactgttactcattttttggcgcgatttagggccacaaaactagagtttcgtctgattccaaaattttcgtgtgctatagcccacggcttcagcatgagttcgggcgaccggaccctgatcacctaagattttgccggcccatcaaaaatgacctaaggaacaatagtcactgcatcgctatgacaattactctttttttggcattttatggccataaaattggaattttgtctaattctctaattttcgtgtgctatagcccacttcatctgtaggggcccggccgaccggatgtggatcgcctaaatttttgtcggctaaaaaaaatgacctaaggaactatagtcattttttgtccattgactgttactcgtttttggcattttaaagccataaaactgaaattctgcccgattcctagattttcgtgtgatatagcccacaccttctgcatggggcttgacaatcgaacccggatcgcctaaaatttttttggccaatcaaaaatagcctaaggagcaatagtcaccgcctctccataacctttcctcgttttttgtgtttatggcgataaaactgaaatcccgctcgatttttgaattttcatgttctaaacccacgccttcagcataggcccgggcgaccagatgcgaatcgcctaaaattttgtcggctcatcaaacaaccccgaggaacaatgttcaccacctcaccatgactattactcattttttggtgatttaggaccataaaactggaattccggctgattctcacattttcatgtgctatagctcacgccttctgcataagcccgagcgaccggatgcggatcacctaaaattttgctggctcatctaaaatgacctaaggaacgatagttatcgactcgccatgacagctactaattggcaatttaggactataaaattcgaattctgcctgatttctcgattttcatgtgctattgtccacgacttctacataggctcgggcgaccagaccagattcgcctaaaattttattagcccataaaatgacgatagtcaacgcatcgccatgactgttacactttttttagcattttagggccgtaaaacaggaattccgctcgattacattttcgtgtgctataggccacgccttctgcacgggccgaggtgaccggatccgactcgcctaaaattttactggccatcaaaaacgacttaaggaacaatagtcaccgcctccccatgatcattaatcatattttgggcgttttagggccataaaattagaattttatctgattcccagattttcatgtgatatagcccatgccttttgcatgggcccgggtgaccggacgtgaatcgcctaaaatttggtcagtctatcaaaaatgacctaaagaacaataatcatcgcgtcacaatgaccgttacttgtttttttggcgattttgggccataaaattggaattccaccatattcctagattttcgtatgctatagcccacaccttctgcatgggccaggacgccctggcccgattcacctaaaattttatcggcccataaaaaaggacctaagaaacaatagtcatcgcatcgcgatgaaaattactcatttttagcattttagggccataaaacatgaattccgctcgatttccatattttcatgtactatagcccacgctttctgcacaagaccgggtgaccagacccgactcgcgtaaaatttttttggtccattaaaaacgacttaaggaataatagtcatcgcctctccatgaccgttactaattttttgggcgttttagggccataaaattaaaatttcacccatttctcagattttcgtgtactatagccctcgccttctgcattggcccaggagaccgaaccttgatgcctaagccggccatcaaaaatgacataaggaacaatgccttcgctatgccgctactcatgtttttgcattttagtgccataaaactagaattccaccagattcctaaattttcgtgtgtcatatcccatgccttctgcatgggcctgagagacccgattcggatcaccaaatgccccataaaaacaacctaagtaacagtagtcacctcttcgccatgaccgttactggttttttggtgttttaaggccataaaatcggaattccgcctgattccaagattttcgtgtgctataactacgccttctgcatgagcccgggcgatcggacccggatagcctaaaattttgtcagctcatttttaaaatagtcacccttcgccgtgaccgttacacattttttgagttttaggcagtaaaactagaattccgcctattctcagattttcttgcgctgtatcccacgccttttgtatgggccccggcgattggacccaaatcgcttaaaattttgtcggcctatcaaaaatgacctaattaatgatggttaccgcctagctgtgaccggtactcatttttttggcaatttagagccataaaactagaattccgctcgattcctagattttcatgtgctatggccaatgccttctatataggcccggacaactggaaccttatcgccaaaaattttgccagaccataaaaaatgacttaaggaacaatagtcaccgcctggccatgactgttactaattttttggcgtcttagggccataaatgtggaattcccccatatatccagatttttgtgtgctatatctcacgccttctgcatgggcccgggcgactcaacccgtatcgcctaatatttttccggcctatagaaaatgacttaaagaacaatagtcaccgcctcgccatgaccattactcattttttggaatgtagggccataaaactggaatttcacccgattcccaaatttcgtgtgctatagcccacatcttctacatgggcccgggtgatcagacccggatcgcctaaacttttactagcatatcaaaagtgacctaaggaacaatagtcaccgcctcaccatgaccattactttttttttttggagttttaggccataaaacttgaattctgtctgattcctagattatcgtgtgctttagcccatgccttctgcatgagccatagcgaccgaaccttgatcgcctaaaatttgactggcccttctaaaaggacctaaggaaaaatagtcgctgcctcgccatgaccgtactagtctttttgtgttttagggccataaagctagaattccgctagattcccaaaccttcgtgtgctatagcccacgccctgcatgggcccgggcgaccaaacccggatatcctaaaattttgccggccatcagaaagacctatggaacaatagtcaccgcctcgccatgaccgttactctttttttggtgttttatgaccataaaattataattccgcctaatttccagatttttgtgtattataatccaggcattctgcatgggcacgggcaacccttcctagatcgcctaaaattttgtcgtcccataaaaaacgacctaaggaacaatagtcaccatcctcgccatgatcgttattcatcttttagagttttagggccataaaattagaatttcgtatgattcacagatttttatgtgctatagcacacaccttctacatgggcccggtcgaccggacccgcatctcctaaaattttcccagcccatcaaaaagggcctaagaaaaaatagtcaccgcctcgcacagccatcactcattttttggcattttaaggctataaaattgaaattccgctcggtttctagattttcgtgtgctataacccatgtcttctgcatgggccgggcgacaggaccctgatcgcctaaaattataccagtccataaaaatgacctaaggaacgatactcactgcttcgtcatgacaattacatattttgttggtattttagggccattaaataggaattccgtccaatttccatattttcgtgtactatagcccacaccttctgcatggtccaagacaactggacccggatccccaaaattttgccgactcgtcagaaatgacttaaggaaaaatagtcactacctttccatgactattcctcatttttggcattttagtaccataaaactggaatttcgcccgattcccagattgtcgcgtgctatagcccacaccttttgcatgtacccaagcgaccagacccggatcgcctaataattttcggcccatcaaaaatgacctagggaataatcgtcaccacctcgccatgaccattgctcattttttggcgttttagagccataaaactgtaatttcactcgattctcaaattgtcatgtgctatagcccaccccttctgcatgggaccggacgaccagacccggtcgccttaaaagttttttgtcccatcaaaaactacctaaggaacaatagtcacccctcgccatggccgttgctcgttttttggcgttttagggccaaaaaactggagttctgcccaattcttagactttcgtgtgctgtagcccacatttttgcatggtcccaggcgactagactcggatcgcctaaaattttgcaggcccatcaaaaatgacataaggaacaatagtcaccacctcgccatgaccgttgctcattttttggcgttttaaggccataaaattggaattcctcccgattctaagactttcgcgtggtataatccaggccttttgcaaggccctgacgaccggacccgaatcacctaaaatattgtctgcccataaaaaatgatctaaggaattatagtcacttcctctccatgataatgctcattttttacgttttagggccataaaactagaattccgcccaattccaagattttcgtgtgttttagctcacgccttctgcttgggcccgggcaatcggacctggattgcctagcattttgctcgcccatcaaaaatgacctaaggaataatattcatcgcttttccatgcttgttcctctttttttagcattttaggaccataaaaatggaattcagaaagattcctagatttttgtgtgctgcaatccacgtcattttcatgtaatcgggcgtccggccccggatctcataaatttttgtgagcctatcaaaaatgacctaacatagtcatcgtttcgccatgtcttctctttgtatcttggtttaggcccatataacagggattcagtaagattcccatattttcgtgtgctattgtccacgccgactacatgaattcgggcgtttgcccccaaatctcttaaaatttagcgggcccatcaaaaatctttcaatgaacaatagtcatcgcttcactatgaccgttcctcattttttggtgttttagggccataaaacaggaaatcaagattactcccaaattttgtgtgctttagtccatatctactgcataaattcgggcaactggttccgaatctcctaaaattttgtgggccagtaaaaaatgacctaataaaaaatagttataatgtttcgccatgaacattcatcatttttggcatttaggtccataaaataagaattcaggaagactcccagattatcgtatgctacagtccatgccatctgcatgaattcgggtaaccggctccggatctcctaaaagtttacggttccatcaatttatagcattttagggccataaaacaggaatttaggacgatttctagattttcatatgctattgtccatgtcaagtgcatgaattcgagcgactggtccagaatcgcctaaaatttaatggagccataaaaaatgccctaatgaacaatagtcattgcttccctatgaccgttactcattttttggtgttttaaggccataaaacaggaattcatgaggattcccagattttcaagtgctacagttcacgccatctctatgaattcaggcaactggcctagaatctcctaaaataatcgacacatgaaaatggcctaatgaataatatagtcaccgcttggctatgaccgtttctcatttttgtcattttacggccataaaacaggaatttaggataattcccaattttcgtgtgctgtagtccaccccatctgcatgaatccggacgaccgactccgaatctccttaaattttatgagcacataaaaaaatgacttaatgaacaatagtcgtactttggcatgactatttctccttttttggtattttagggctataaaatagtaattcgagacaattcccaaattttcgtgtgctacagtccatgcgatctgcatgaattcgggcgatctactttgaatctcctaaaatattgcggacctaccaaaaatgacctaatgaatagtagtcatcgcttctccaggaccgttcctcatttttttttgcattttaggaccataaaacaagaattcacgacgattcccaaattttcgtgtgctacggtccaggccatctgcatgataattcggatgaccggccttgaatctcctaaaacttgtggtcctataaaaaaatggcctaatgaaaaatagtcaatgctttgccatgacccgttctttgctttttagcattttagggccataaaatagaaattcagcaagattccaagattttcatgtgctatgtccacgccaactgcatgaatttgagctaccgaccccgatctcctaaaatttagcgggcccatcagaaactccctaatgaacaatagtcatcgtttcgtcatgaacattcctcatcttttggtgttttaggtctattaaacaagaaatcaagacgattcccaaattttctacaatctacgtcatctacaagaattcgggaatccggccccaaatttcctaaaattttgtttgggcccataaaaaatacctaatgaccaacattcgtcactttgccatgactgttcttcattttttagcgtttaaggccataaaactggaattcaagatgatttctagatttttgcgtgttatattccatgcctctgcattattccgggcgaccgactccgaatctcataaaactttgtgtacccataaaaaatgacctaatgaacaatagtcattgcttcaccatagtcgtttcttattttttggcattttatgaccataaaatagaaattcaagacgattcctagattttcatgtaatattggccacaccatctgcatgaattcggacgaccgacctgaatctcttaaaattttgcgagcccataaaaatgacctagtgaacaatagtcatcgcttcaccatgatagttcctcattttttagcattttggggccataaaacaggatttcatgacaattcctttccgtgtgctatagtccatgccatctgcataaattcaggcgaccaacctcgattctcctaaaattttgtaggtccattaaaaatgagctaatgaacaatagtcatcgattcgctatggccattccttatttttggcattttagggccataaaataggaattcaggacgattttcatattttcgtgtgctatagtccacaccatctgcatgaattcgagcgattggccacgaatctcctaaaattttgcgggctcataaaaaataacctaatgaacaatagtcatcgcttctccaagaacgttgctaattttttggagtttagggccgtaaaacaagaattcggtatgattcccatatttgtgtgtgccagtccacgtcatctgcatgaattcgggcaactggccccgaattccctaaaattttataggaccataataactatcaaatgaacaatagtcatcgctcgccatgaccattcctcgttttttggtgttccagggccataaaaggaattcaggactattctcagaattttatgtgctattgtccatgccatctgcatgagctaatataatcccacaagtgagatctaagaggatagtgtgtacgcagactttacccctacttgcacaggatatgacaggttaatgttgaacttattgttgatagcttagtgttcattattttatactccccctattttcaaaagattggcattatttcctaattagtttatttcaaaaagattgacatctttcactatttccttaataagaagcagttatatagccatacaaagctatgcatgtttcagaccacaagtttcaaaagttttacggtcacacaaatattatgacttaattaagataatatatctcaaaattcttcccttctttattaaagtttgtatcaagtcaaactaagacgaactttttaaaatatagtgagtaaattataaccaatttcattttgctacaggacgtgctaagtttcttaaagagcgtgaaggataagcacgtagatgttgctattttggaagttggattaggaggcgaatatgatgcaacaaatgtggtctttttcttgtttctagcttgatgttcggtacccgcattggaacccgactatatctgaattcacgttgggtaggacctcattcgggggaaccgctccctgtcaaaaatatataaatgttggtcttgccattgcattatgctctacttggctacagagaactggtcactttgaaatcaattacttcctccgtcccaaaaaaatgatataattcagagttcgaaattcgagagtcaaatttcttaattttgactcagagatactcttcgtaaaaatcgatcgggtctttagatgctgctagcaatttctaatttgcccctccgtatagaattcaaccccttagttatatcagctccatttgaaccctagctctcatcatgaccaaaaaaatttagaattagctaagaatgtcgtcgctaatctgtcgctaaaacgctcgtaactgtcaccaaagcatataagtatgattttctgaaattgttcaattacaattgtcatatttctaccaagtacccttgactagggagtacgtaacttttttcatatgatatgaacagaactacatatttctgtttcacaataaataaataaatttttttagaattttcctcttttttggctcgcctatgcatgaatttactcatcaataaatgattaaaatttcaagtctctatataatttacaatttagttatatatatattgaccgtataaagattttcttacactacttttacatattataaaagattgttttccatttttcaaagcttacccattaatgtatctatagagcatcatatgtagttgcattatatttaagtaaaatttccttacactataagaatatttcaaccttctataaaagattgttttccattttttttcctgcaagccctaatggggtcttataagacacgaaattaaatagttggacccaaagcctgtttggattgacttaaaaaaatgaatcttcagtacaaattgttattttcctgtatttgtacaacaattatgaataaaataaataacttaaacagaaatgtaaatgaaataagaacaccaattcgagcccactgaattcacagtgtttccttaaggaatttaatcccctcctagtacccaaggttatggattatttcctcccaggatagaacgaattacacactggtgtagtggtacttcaaacaccagtgtttcagcgaacacaaagttcgatagcaaatcacacttactgttactttctttgaagaaaaactatgcagaaggaaggagaagaactcagaaattagtatgtaaaatctgagagaatagacttgtatttatagccaaagttgggctgaaatttgaagaggctgtttttgcaaaacgcccatagaataaatgccatgacataattggctatttactcaacaataaagagggaaaattgaagggtagttaattttctgttacaataacagaaaactgaaaattgaatacctgaaatggatttaatattaatattaattttaatattaatattttattattaaatatccacaatgttaattttaatattaatattttgtaaatagcatcaataagaatttgctcatatatatattatgagaaaattttgacctattaaattattttccaattttataatgttaccaattaatgtttggtcagtgcatagacattataaatatccacaatgctctaatagtttcgtaccctcaaacctaaggtttttttctttttcttattatttgcagtttcactttgaaaaatacaactcaatgacaatgaggagcattaatggtgaacgaagcattttcatggtttatgtggttttcttgcttgtttcattctctggtatatatatcacctctcttcttttcttctcctttcattgtatttttcttgtttatttttgtattattttcgagaaaatataagtgaagttagaaaatctaaacgtttatgcatgtattatacatattatatatatatatatacagtcagactttctttataacaatgatcccctgtagcacgttactgtaacaaccaagttttctttggaaccatttttaatattatgttataatatatattctctataacaacacttcactatagcagccaaaaaatatcgaaacaaaatgattttgttatagagagattgtatataccctagttttcagtaggctgttctctataacagtaattcactgtataagctctcttctttccttctccctttcattgtccctcttctctctctctctttttgtattatttgccagaaaagaaaactgaatatatatatatcgcacacctcttcactataatatccaatttttctttggaatcatctttaatattatgttattataatatatgttttctataataacatgttactataacagccaaaaaataacagaattaacgagaccaatataaaagggtttgactgtatataccctagcttctaataggaccttcttttggtaaaattttagtaaatttttcccttaattaaggattgactcaattactcttaactatcttgaatgttcaatatatctaatcaaaatcttgaatctaagtttttttattaatatctttttatggttttccatgcagtgatacaagtcaatcatgcattgaaattagctgaagaaggtgatactattcaagaaaatcacagtaataacacacagtacgaagtagggttaactgaagtatgtcgaaaagacagcttacaagtaactcaaggaccgtcaggaacactgaacggtattccagtgtactcagtcacaatcataaatacatgcaccactggaagttgttttaacattcacttgagctgtggttggttcagttcaacaagactcataaatcctgcaatttttagaagaattggttataataattgccttgttaataatggaaagcctttaaaacctggacaattaattaattttaaatattctaatacttttagttatcctcttgctgtttctaccattatctgtaactagctagggttttagtgatagtattagtatgagtatatatatatatatgctcgaatagggttagttatatatagaagttttatactatagttgattttaatttgttcgaatatttgaagtgtaatttgttagttgattgattaattgattacactgctattcgctccagttcacaataagtaattttttggctttttttggtgatccaaaataaatgattttttcagatttcaagaatatttttttcctacattgcccttggagtaaataatgttgtagtatgtgttaggagtgtttatgtgaagagatattaaaggttaatatggtcaatttcatgactatttaatgataaaaatgacctttttaatatacgtgaagtaataaaaaatcacttattttggaccagagggagtatatatgggttgcttaactattcttgtgcctaaactgttaaatattgcgccgctcaattctcattagaattgtactaacaatttaatagatgtgaaaccataattttaaaagtaaaccaaattcgatgctaaaacttggccctggagcccgaatagatctttcgatgaggaatttgaagggctcgaaagaggaagaccttacctttccccacactcaaaaccaaaacaaaagaaaaaagatcagccaaaagaacatctaagctagcaagtaagtagattcggggaaaatagaaaaagaaagagatgaaaaatattaggaataaaagaatcacactcctttttctttttattgaacgagaaactagaataagacttagtaaaagtaagaagaaaagacggatcaattctggggtggtgcttctatctgatcctagaaaacatacgaaacaacttgctatgaaactaccgataggagcaaaaacactcatggagcttgaatccttaatatgtctcttgttttacctaaatctaaccccaactatgataacaacaataataatatcaaaattactcttgaaccttgtgattttaaatatgctatgtgctttttgtaagagaatattataaaagataaaataagaatactgaaattaaaaagtaactagtgcagaaagtaggagtagcattttatttacaactcgtttggatggttgttacatatcgtttcataatgtatcaaatcgtattgtattgtactgtatcgtttgatcaatataatgcttggatagattgtgtcgtttgccgtcatttcatgatatcacgcaccagtaaacttgcaatattataaaaaaattatgacacaaggtaaaattactatataaaaaggtaagttaaatgataaaataaaatgatttaacaataattaagggtgagattaagagaaaacgacaaggtaacgtcccgaccataccaaatcggtcgttacataaagtgatacatttcatcgttacgtaacgatagatttaacgatacgataccaatcaaaaaaaatatcgtatttaaagtaacagtacgacaaccatccaaacaaaaagttaaacaaataaaccctataatttcaagccctttttcaaatttctttaactgcaatacagctaagaactaatactaataaggaactgatccaccttataacagaacatagaatcctagccgtcaaattctttaatcaaaatcaaaatcaatctcaaccgttaatcaaccaaccgccttaaatttacaacaaattccgtctattcaaagttcaaaccccgccaaaaaccccatttgaccaaaaacgaacttcacttcatttcattacacacagttcctttccaaagctctcttcaatggcgtcgcccaaatccgcaaaaaaactattcgggcccgacccgtacccgatgatcaaccttctattacatctccattgtgacgacgatcgtctttatcaaccagcaaaaactctgttcaattacaccaagaatcattacccaaatactctaattctcaaactcatcgacatgataaatcgtaaccctttttcgatcacaggtattcgctgttataatcttcttggcgatcttctgccttctctttggctccgtcttccttccattacgcgtaaagacttaaagactctgttaaactatcatttatggcgtgaaacggattatgaaacgttaaaagcttgtgtttcttgcgtatcaagtttagccggtttgttatttcctaaaaatgaatgggataatctgttttacttcatgtttctatttttgggttcgagttcttcgtatagaaatttggcttctttgttatatggaatgatttgattcctatttgtcctgaggtttttatgccttatattgatttcttgattgagggttttaaggatcttatgcctactgtatccgaagatcataggtgtggtgttgctgctgctaaggcatctgtaaaattggttttgtatttgggaaataccgcgaattatagcaagttttatcatcttatggcgtatgtagtgatgactttgtttagggcattaggtgaggaagttcttgtgtgtagtcttcttgaagatttgataattttggccgggcggaaactgagttttttaaggttcagattgatgctgtaatagattcaatggtgaaaataattgagaatttggaggtagaagaggagacaagacaactagctatagagtttgtttttaacagttgctgaggataaggaaaatggttgtggtatgatgcagaagattaataaggatgttgtttctaagttgcttagtcagttaattatgatgttagtacatattgaagatgatcctaattggggaaatgcaattagtgatgatgaaaatgaaggggagttgagtatgtgtagttatgctatggaaagtttggataggttagcaattgcattgggaggaaatgtgattttgtccagttgtcctgagtgtttgttcaacttcttgtatgatgaaaactggagaattcgtcatgctgctgttactgcaatcggtctgatttccgagggttgctcaaaggtattactctcttcgttccattttatgtagcgctctttccttttttagcgagtatgttctgaaaagaatgttacaatcaactttccgtcttacccttagtagcatgttcttattgccgttgaaatgttatactagcatgtttagactacacgttcttagggtacctttggtatgtgtcagaagtaaaacaccgtcaaataagatctccttaactttgttttcattttacccttaaattgttcatatagctatagaaatgttgtagcatgtttagactacaaggtcgaagggtactcagctagcaaatacataaacaagcccttaaacttggcctcaactggcaagtatgctctctaattttaggtgtgcataagtaggtacctcaactttcttcactttgtcaattggacactccaacattcaaaaagatcatctagacactccataacttatgtgtcacatcggcatttgtgttaatgtgttcaactttatacaagttgaggtgcctacttatccacattcaaagttggagggcatatttgccatctaaggccaagtttgagggcccgtttatgtgttatgccttttggtatgtgtcaaaagtaaaacaccgtttatgataagacagagggagtagttcaactttattgtttagaaggctattgagaagtgaaagatgggcttaatatagtatttgcatgtgatttatggtgtggaaataccaggcattgttgcaggagatggggcagcttgtagagactcttgtgatgctaatccatgacacccatcccgagtgcgctgggcaacaattcatgcaattggtcagctttcaaagtatctgagcccgcattttcaagagcaatatcatcaacagatcctccctgctttgctagaagttttagatgattttgacaatccgaggttgcaggtacttcacatcttcttctctgtatcctttttcacacttgtccattgcaaatacatatcattgcatactaatactatctcatttatatatagacacgtgcgacttcaggaatactgttgttcactcgcaactgcagttcagatgtcttgaaaccttacctgcagagaatagtgagtaaattagttgtgtttctacaggtatgtcatttattccaaatctatgagatatatagagtttacgtctgtaagagtaatgacataagtttttaacagtcgtatctctgatatgatttggactaacaagtggcttgctgaattccagagagaaacgacgatgatgaaggatgcggctctggcaactttagcttctttagctaattcatcacaggtactttagggtccaactgttgttttctttcaatgctccggttttctaaacctcgtttgcctcggatattgtaggaggactctgcatacatatatgcttcaactatgccatatctgaaagttatcttggtaactactagtaaagatacaactcgcatgctccttaccaaatcattggaatgtattaccatgatggcaatggctgtcgggaatctagcaatccttgattatgttgagaaggtgaatacagtttatatctttctattcccttgttgcaggcattgtataaatgttgactgtgtttcctggaactaacaaataaaccaatgcagtgaaaatttaagatttaaagttagaaccacatagcggtaaaacaacatttaaaccattaaaatcagggcaaatgaagtcatatttgactagaaaatgcgggaagtactgataagaatttgaatttacaaacggaataggtgtacgctgttgtaaactcgagcatggaccaacttcatttctcagcaaatcttgtagatacagtttatagagaaacctgaaaaaaaaaatacatttatacagattgaaactatcaacatcagttaacttcggaaattacatttaccaacaatgtgtcatttaggtcacttctgcgctcacttcactgcaagaaactcacatggaggtagaagatccaatgaagagccttttgttacaagtatgttgaaacacttagaattttgagacttttcttttctgtttttggctaatttataccagagaaaattattgtttttcttccacttgattatgttgcaggcatggggtagactatgcaaatgcttggggcagatttccttccttatctgagtgtttccatgcccgttgtactaaaacttctcagttaaagaattatttgagtgtttccaacgattcagatacagaggattctgattctgatgatgaaaggttgaatcttcctaaaacactcgggcgaaatttcacttataatgcatgtcatatgtgttagtactaggtgtgcatgtagatggttgtgaatttcacttaagttgcttattttagtgactgagacaatggtcccaacattgtgtcacaaagatagtttgagaaatgtcgatttcagcaagtaataaagagaaacaaagtcactaaaataagcaacttatttggcataaatttattgaggatgtcttcatctgaaatataaatatgttctgtagcatgattaaagtcacttcgggaataaaaagatcggtataagaagcacacttctggaagaaaaagccttggcctgtcatatactatgctgctttgcagctgagttaaaggaagggctgcatttatgggttaatgaggtatgtcttgaataattacaatttacaaggataaaacttgtggtttctatcacatgaagatgaaaatttctatctaacttgtggtttatacaggttgtaagtgctttagttccaaatcttacctttaaattcagcgaagaagtaagaatggctgccatttctggtaaatttctacatgtctttctaatcattcctttcaggcgttctgaactttatctgatgttttgctaaattgcatttacaccttttgtagcaatgccattactgttgcattcagctgcttttgctgtgaggaaagggcttcttgtaacaggttgcggcaagcccccagttcaaaagctatttgacaccataatcccggctttgcttgctgcattacagaaggtaattaacctagagttgcagcaaaagtttaatcaaatatcatattgatacgatcttttaacgctactttccctttaggagtcaaaggtacaaattcaagcaagactattggacgcattcaacgaaagcattcaggtcagcatactattttctcttctgtatactattcttcgtatgtttttcccttgagcttcatttgaccgtgcactaaaaagtacttactcaacagattccgggctcgcatttaagtaaacaccaagctgcaaaattcattgatcgcatatcagaggttctctcaacttgctcataccgcaaaacagaaagagagaaaagggtaagagagcgcaacgattcaagggagcaggaactgcttaaggaggaaactgagcaacacttaactatatgtagaaatgttagtgttttatctcaacacagcccctatttctctctctctctctctctctctatatatatatatatataacaggatcttagactcaccttcgttagtttctctgtttcatgaactcagatcagcacttgcctgggaactatggtgaaaaacctcaaggcatcattcttgcccctttttgacaaatttttgcctcatgtatcacttatgtgggtaagttactctctctatcatgtactatatatgtaattcaattcgtgacacgtcctattgaagcatcaaaagtgactaaattgataataaactgtcatttaaaccagtctactgagcaattgtatggtgacacttttatggtttccttgacattacacttttcctattcactatactcctctgtggaaggagagccttggagcaacgataaagttgtctccgtgtgacttataggtcacgggttcgagccgtgaaagcagctttttaatgcttgcattagggttggctgtctacatcacaacccttgaggtgcagcccttccctagaccctgcgtgaacgtggatgccttgtgcatcgggctgccctttttatacgcaaacgtgagtttccctttacttttctacatacttctgtacagagtaatgatagaacagcagaagaaagaagaatagtagtgcaccttttccgtgatgtcgctgagcagtgccgagaagatgcattcaggcaagtcttgtcttttgtgctttcagtctcttattagtcaaggataagcacaattggctttacctgaacttcatttttgattatctaaaagcaggtactatgaggattggatacctctcctgcttagagtttacgatcataacaatccagatgttcagcaggttttattcccctacttttacagttgtttccctagaaatcagccttatatatttcaaatctgacattctatatttttcagttagtagcaactgcagttggtatttgtgcagaattcggaggcaatatcctcaagcctcatactataggtaatttgtgcattataatatgcttaagatatttatttctccactagcaagactgacttagctttctaatgttgtttcagtaatattcaatcatttaaaatctgtaatggagcatcccaatgcaaaaagcgcggataacatcatggcttacgaggctgccatttctacctgtgggaagttaagtcagtttgtctggaaggcatttacacctttaaggttcctctcttactactccttccctatatcaacatgccattagagaaataaaatggatttcacatcgatagaaagaaagtccccgtctttctctgtatcagtagtagcatcagcctcatcattattataaataacacacattcagtttgcactaaaagaaaacttcatacgctagaatacacaaaccctcaacacaaatttacgacttctcttgataaatttgtggtttattgaatgacatattatgaacttcgttgtctttcttgatttacgaaactattttacgtggcagtttatcttgctttggcttaaccacttaccaataaggtgtaatttggatgaggctaaagtcagtcacgaacttctttgttcgatgatggaaacgtaatttttttttttttttttttttttaagttgagaaataagcaataaatgattataaaacttccaacatttcttatgcattgctggtgttgtgccttgttctttcaggtcagagaagaaagttattggccctcaaggaacttatttaccgaaaataatagcaatttttgctgaggtagtatttccttttcctgtatcacaaagaatgtacagttccaaatatccagtaaaaggatcctccatttcatatattatctttattctttctcttttttaggttttatgggcagggaacaatttagcgacagaagaaactatcaggcgaatgatcaatctattgaagaagttccaaagggaacatcagccttctgtcctgtccaacatatatgcaacattacctttaccacatcaaagcatgttgcgcactgtcttgtccgccatataaattgtttgtgcattctttgagtagatacatgtatagaacacagaagtagctaacagtaaaagtagcagactcaaacttgtatagacagaaaaagattcccccacccctcaaacccaccccaaatcttcctcctagtactgtaaagagtgcgattgtatacaacggatgaagtatgagatttttgtgttcgaaaggaatttaccagattttatgaaaataagatctaaacatagatggaatgttattacaagtctttctgctctatcttgtgctatatttaaggttattttctttcgtgtattaacttcgaattgcaattaatttaacctcctttatttaatcattcatggtaagaagtcaagttgaacctatagttgtttagttacactatcaattttggcaaaagctagaaaaattctaaagtgaaacacacactaggttttcttatctatgagacaaagagacggaaaaagttgtcccatcggagactttcgataagcaaaagttaagacagaaatgtgaaaatgcataaatctaacttcaatgagcttattgttcttcaaattacctgttgcagttcccccttaaagatcatgtggcactgaggttgcgtccagcgttgtagctacttctttgaagtgcactaatgaagagagatctgatgatagttctgataaaagagagcttctatcgtttcagaagaacaagaaacttccattttctgcttcagttcctttcgtttccgcataaggcattcatctcccaattctcaattcattgtgaagtatatagaaaaatcagcctcatttcaaccgtctaaagaatagaaattcagttgccgaactgcatcaaatacggctgtgtaaccatagtagaagaatacgatatcatatcatactgaccaacgtacagaatgatgagaaaacactcccaaaatcaagagaattgatcaataaaattggagtaaccataatttgttcacataatacagctaaatcacatgaagccaaccaaaataaagcaggcatttagaggaagtgaagctccatacagacacgacagtaagggacgttcagaaacgaacaaacaaatggcgtaaagataaaatagccatcagataacaagaactagttgtctatactagaacctgaaagttatgaagccactgacttgcacgagacaaataagacgagctattcacttccttatgcaatcttcttcaacatcaaatatcactcagatcaagatcagcaagtaactcctccaaaggaatagaaggaaatcttccccatcagcaatagatgtgacttcgatcgttgatattctttattacgatacaatgatatgttgaacctcagatcaggattctcctctaaatctctcaagaattgttcatattctgagttcaacttttgttcctgatctttacccttgccagagttatcgacttccatattaagagacttaagcttccaagaccgaggctttcccacgtttcttttggcgcttctctcgtagcttttcttaattaatatcacctccggaaggacaagacctttgtatttgtcgagctcaatatcattactattggctccatataaatcataaccgagggcgtagtctcctggatttagaagatggcctagatgtgttcttacggagaacatagtatcatttttcccgaaatcagatacacgagccacttgagtatcagctaaaacatacgtagagcccccaatattaacttcttcagaaaccacatcaacgtctaaaactacatactcaacaagctgcctactagacaacaaaggcttaaacgacgccctccagtactgatcagcatccaagaaacaatgcctcagagtaaacggatctaataaagcaatattgttgctcagtttggtgcagatcacaagaggaccgatatttcctaaactagctgctacctttggagggagacatatcaaatcctcacgacaaatcgggctgatctctacagagaatgtgtacttataattgaattattgctcttgtgatcatgagatacaagttgcttgtcatttcggctcctaacaggtaccacccgactcaccaagtccacaaacttcaaagcatgacttctatgtgcaaagaagaaatcaattcctgaaccaactgttgaatttttatggcacgattagcagccccgtgcttaagaatgagctgctccaaatagaagaaagttcttcgatgagaaacgtgctgtctaagctgcacagccgccgcccattgatcaggattagcttgcacctttgaacaagattcacacatttggtcttgaacaacatactcaacggcatatgtttgttcgagaactgctccatttagaacctctttttggactctaagcctaactttgatccttttggaatgaggttcagtccaaataaactcgcattcatcaactaactttatttaaattcttcaacctcttgatacaaaaggtcagtaactccttcgattcgagctgtgctttgatccaagacttaggaggctgcaaatagctatcgcattcggggcaatggacaatcacaacattcttctgtaagccttctttatatcaacttcggatcgcaagcatttagcacacatattggcagcatttggttgcatcaaaattccacatttgcaacataatacactgcctattgtttgttgcactgtatcatacctgatacttctgcatacctattagaaacaaaaaggattgtcacaaatagccagccagatttaatgtttactttttcagcctgtatacataattatattatacatgatatttttactttaggaattaggtgcccgtttggatgggcttgttttaaacaaacttttaagcctaaagctataagttaggaattctatcttttagcttttggcttatttttgtgattttagcttaaaaacatgtgcttaaaagcactttttactttatccaaacactacaaaatgacttaaaagctattttagcttaaaaagacttaaaataagcaatctaaacgggtctaggtggatggcacttaaaaaatcaacaattagatatagctttccatggcagataacctaagttgctcagacacggcgggtgtccgacactggtgcggattagagatcggatatttcaacatgtacattttaagatttggggatacgatcctagtaaggatacgggtgcgaggatccggctaaattaattaaaaaaaataaaaaatctctctaatttatgagaaattttgtggaatacttacgtatagcttgtaaagtgtggatttccttttattctcgagttgtagataagtaaaagattgatttcctagataagatatgctattttcttcaaatttaccctagttttagttctgatttcggtaatcaaattgtatttcgtctcaaatttttctgtccttcatggtcaaagtacccaaaaattgtttaaccagatccggtacgaatcccatacccacactcttactagtgtcatgtcaatacgggtgcggcacctaaactgccatgtcggagcaacttagtagataactagcagaaagttacatatattttaatttcaattatcctttgcttgtattaaaaaagaaacaagttgaaactgaataattctccaaaataacaagtattccctctgtctaaacagttttttaactatcatttctttaaagtatttataataaaataagttacaactcatacaacttcttagataatttctaaaaatgtaaattttattctaacaaaaaataacagattgatgtctagttcacattaaaaatttacaaatttgatatttttattaaaatagaaaaaaagagcacccttttcttccttgtaccaaatgaataagaattggatgatcacaaacaaataaagacatgaaattgattgaaaaaaagataaagaaaagaaaagaaaatagaaataaattttttcaatttgagaaactgaattgagagattaatatacctggaattgaagaagagagaaaactgaatgatcaaaaattgaagttgataatattaaggaagaaatatgtggagttaatttttatttttatttttctgaaatttattgttatttttggaccataaaaataaacaaatttaaccgactttaggaagagcgtggcgtcactgcttactacttagtcttcctttggtgttgaatcatcaattcaattatacatgtcaaataaagaagtacattcacaattttatttagctcagctacattaacagagggtgaaattcaaaaatagccagatttataagtgttaattgaaaaatagtcacggttttaaaagtaattgaattttagcctcttttcatataaaaataaatgtagacgaaaatactgttcaaaatcaggaaaatattccagcataatatattggagttagaatttattacatgtgaacttccaacataatatactggagttctagtatatttatactggaaactactagaaattcggcaaaaaccgatcaagaaaaaccgaccaactttgtcggtaaaaaaacaaatatttttttttttttttaagaaaccggccaactttggtcggttttctttggcgcaaaaatgcgaaagaaagagtatatggtcggttaattcgatcggtcattttaaaaaaccgaccaaagttcgtgcgaaaatacaatgaaagagtatatggtcggcattcctttccggccattaaaatatcgtccacacgtaaatggtcgcattttggttggtaattgccctaaccgaccaactttggtaggttttagcgaatttttagtagtggaatatactggagttgcggcataatatgttggtccaacataatatgctggaagttcatacacaggtgttccaatctcctgtatattatgctcgcacttttcatgtactggagttccagcatacaggtgcaccaatctctagtatattatgttggaactttgcgtgttgcaacaaaatagtagttatttttcaatggctttgcaaatgctggctatttttcaattaccagtctgaaaactggctagctcatgctacttttacacataaatatgacccaatgataacttattcgacccgacctataggtacactaatgtaaacgaggagttgagcatgaactgccgaatcttaatcactttcgaaatcatacttccgacaactaacatgtgtctagtccagtggaaatttgaggactcaatgggaaattattctaaatatgcttagaatataaccatgagtgcaacaacttatgcttaaatttgcaagaaggtaacaaatatgttgtgtatgtattcatttgcaacataaagaaccttaggaccgagccatttgtatctatacctattttttgggtcacattttaacttatacccactttacaaaaaaattacaagcggacccacttttcgcgtaacttcaagcgtacgggcctgaagtagcaaaaatttttgcctgaagtgtagcaaaacttcggatatttttgcatgaagtttggcctgacttgcaaaggcatcaacgcaacttcagtttatagtgcaaatggcaaacttcagtttaataaaacaacaacatgtgtttctgaagtttttgtttgtaattgctgaacttcagcattctagtagctgaagctttgtttataactgctgaacttcagcattctagtagctgaagctttgtttgtaattgctgaacttcgcattctagtagttgaagcttttgtttgtaattgctaaacttcagctaattagctgaagttctgttctatatttgctgaacttcaacatgttttaattgaacctttgttctgtttgtgatgaacttcagggctgaagtttgtttcgtatttgctgaacttcagcattctaggagttgaaatttttgtgtacatttgctgaacttcagcattcgtagagttgaagttctaaaacaacaatgacaatttgtcattaagatccagttgctaactactatttattgtatattttagccttagaacaatggaattatcaggaaatttgaaaagcaatactcttataaaacaagaccattagtaaaagtaacatcttcacctactgcacagggaatcaactcgtgctttcgtgtttaagtagcaattagcattagaatttccgaattggacaacgctctcaatcttcagcattcagaaaccaaaggaggagctgaagttgtttaaacagtgggtacaagttaaaaaaattttaaaaagtaggtataggttaaatgagggcggccaaacagggcaccccgtgaagtttttaccacaggaccgggtatgcaaatggatttatttgtcgaaatgacaccgggtagccactttaaagggttgctatttaagaattagtcagtgcgtcatgaattttagtttttgagttcaaattttcaggacaaaaaaaaaatcctgaagttaagatttttagttttgttatgaaacaataaaagaagaacaatattgcagagaaagagagaggaaattcttattgaattttggaatgatttacaatggggtaagacccctctatttatagggaaaaaatgacttagcctcaaagtaaaactctctaaaagatagacattcactctaaatagaattctatttataacaatcccccttgaatgtctattcaacaaataatgtgtctcgttaaaaccataactaaaataaaacccagcgggaaaaaattatagaaaaggaaaaagagtacacatgtttagaaatacgccttttggttgcctcgttaaaaaccttgcaaggaaaatccagtgggacaaaaccttgtaagggaaaaagagtacaatgcgtattaattcccgctgatgagagcatcaattcacatccttgagccttcgcattccaatcttgtgcactagcttcttgaaggttgatgtcaccagagatttgatgaataaatcatccatattaacttcaatgaatatgttgcaccttgaaaaagtcctcgctatcacattatcatgcttatagagaattgataatttattccacgtaacattttctcaaatgtttatcatctctcctacccgtgttagaaaaactaacttgcttcctcaactttggaaatccatctttgtgcattatggtgttaatcaaaatatacaccgcacatcaacaataataagatggaattatttggtccttaaccctgtaccacttgtgaggggagaatgtaatatattgtggtatatgatctatatcaaactgatatagataactttgttcttataagcaatagtttaactattaagtggaggcactcaataagtcatttcgctaaaccaactgtgatgtaaaccaatttatcaagataaactgtcttggatagaaaatttggaaattatgctctaaattaaattattgagcaagttacctcgcaaacaccatgttgcgggttaataataatcgcacatgtaaccatctcatagatgcatcttttgtggtatacatggcaggtgaatgggcccagattcacatttgatatttccagcatttatgggattcaatcccaatttttagttggtataataatcgcgagaacaagcaacataagagaattcgtaaagaacttactagttctttaatatttacccatatgaatactcttttacttttgcacatcatacttgaattaacatggctaaatcaattatgccgaccagataattatcaatattgataaagttcagatttatattatgacgtgtgtaattatcaataaactctaagtttattatgatatgggtttttatatcaataaacatccactttattgtggtattcttatatttgtgtagtacaaactggagaataaagcgggtaacttttcacatatatattaccccgctacgagttttaaaaataaatctttcatttatttctagtctcaatataaccaactgctttcgcgaatactttagaaactcaattatgtttctttgagacttactacaatacaataaattgacatgataatcaattgtattcctccaaaatagtaataattggctctttcagagctctcaattaattttgtactatcacatattcatcaacatccatatggtgaatatctctttcaaatagaaagttataccattatagtcatggtcaaaatcattataggcaagatatgttgcttctattacttttgccatgtaataatcgcattgccaaaatatttggaataatcacaatagatacgtgatcaatgaccattcgtgccataataataaaattattttcttatttcatctcaaacctccttttagaggtgagtgtggtatactcactaccactagcacgttcatattcttccaagaatgaatatgtattcataaattagatgttgtcacattcacatcatgaattgaccataatcatctatatgtgctttataaaatctcatgtcaaatcgatgacaaatattactttcaaatagtgaaagattattttgagaattcttattattctcattatcacaatgatgacgattataatttcgtctattgccacgtccacatctattgataccttcacggtaataattttgtcttctttcagacttatcgcatattatcacattctcttaaggggaatgagaatgaagcaaattcaatgggacgggtttccacttctttgcccacaatcgtacatgaatttgattatggcaagcatagaagttttactacttcgggtagttatcatctcttataaactccaatagagttataatcaaaatttattgtctttgctagtatttaaaatcaaattatagtatttcaagaatttaaaacagaaaaataaagtaaaacacttacctttaaatccggaatttaatcatgaacaaagttcatggaacaattgacaatcattattctcaattccaaagcttctactcaattggttagagtctcgtgctgataacatgttataaaacaataaaagaacaagaacaatattgcagagaaagagggagagggaattcttattgaattttgggatgatttacaatgggtaagaccctcaatttataggggaaaaatgacttagccttaaagtaaaactctctaaaagatagacattcacgctaaaaagaattctatttatatcactcccccttgaatgtctattcaacaaataatgtgcctcgttaaaaccttaactaaaataaaacccagtgaaaaaaaattttagaaaaggaaaaagagtacacatgtttagaaatgcgccgtttggttgcttcgttaaaaaccttgcaaggaaaacccagtgggacaaaaccttgtaagggaaaaagagcgcaacgcgcgttaactccccctgataagagcattaattcacatccttgagctgtcatgttccaatcttgtgcattagcttcttgaaggatgacatcagtaaagatttgatgaataaatcatccgtattaacttcaatgaatatgttgcaccttaaaaaaatcctcactatcacattatcatgcttatagagaattaataatttattccacgtaacttttctcaatcgtttatcatctctcctcctcatgttagaaaaactaacttgcttcctcaactttgggaacccatctttgtgcattatggtgttaatcaaaatatacaccgcacatcaataataataagatggaattatttggttcttgaccctgaaccagttgtgaggggagaatgtaatatacttttgtatataatgtatatcaaactgatatagataactttgttctcataagcaatagtttagctattaagtggaggcactcaataaatcattttgctaaaacaactacgatgtaaacccacttatcaagatgaactgtcttgaatagaaaatttggaaattatgctctaaataaattattgagcaattacctcgcaaacactatgttgcgggttaataataatcgcacatgtaaccatctcatagatgcatcttatgtggtatacatggcaggtgaatgggtccagattcacctttgatatttccagcatttatgggattcaatcccaatttttagttggtataataatcgcgagaacaagcaacataagagaattcgtaaagaacttactagttctttagtatttacccatatgaatactcttttatttttgcacatcatacttgaattaacatggctaaatcaattatgccgaccagataattatcaatattgataaagttcagatttatactatgacgtatgtaattatcaataaactccaagtttattatgatatgggtttttatatcaataaacatccactttattgtggtattcttttatttgtgtagtacaaactggagaataaagcgggtaattgtcacatatatattacccgttaagttgtaaaaaataaatctttcattttatttctagtctcaatataaccaaccgctttcgcgaatactttagaaactcaattatgtttctttgagacttactacaataacaataaattgacatgataataattgtattcctccaaaatagtaataattggctctttagagctctcaattaattttgtactatcatatattcatcaacatccatatggtgaatatctctttaaaaagaaagtcataccattatggcatggtcaaaatcattataggcaagatatgttgcttctattacttttccatgtaataatcgcattgccaaaatattttggcataatcacaatagtacgtgatcaatgaccattcatgccataataatgaaattattttcttatttcatctcaaacctccttctagaggtgagtgtggtatatcactacactagcacgttcatattcttccaagaatgaatatgtattcataaattagatgttgtcacattcacatcatgaatggaccataatcatctatatgtgctttataaaatctcatgtcaaatcgatgacaaatattactttcaaaagtgaagattattttgagaatccttattattctcattatcacaatgatgacgattataatttcgtctattgccacgtccacatccattgataccttcacgtaataattttgtcttctttcagacttatacatatctatcacattctcttaagggaatgagaatgaagcaaattcaatgggacgagtttcaattctttgcccacaatcatacatgaatttgatcatggcaagcatagaaattttaccacttcgggtgttataattcttataaactccattagagttataatcaaaatttattgtctttgcttgtatttaaaatcaaattatagtatttcaagaatttaaaagaaaataaagtaaaacttacctttaaatccgaatttaatcatgaacaaagttcatggaacaattgacaatcattattctcaatccaaagcttctactcaattggttagagtctcgtgctgataacgtgttataaaacaataaaaaaacaagaacaatattgcagagaaagagggagagggaattcttattgaattttgggatgatttacaatggggtaagaccctctatttataggggaaaaatgacttagccttaaagtaaaactctctaaaagatagacattcacgctaaatagaattctatttataacactcccccttgaatgtctattcaacaaataatgtgcctcgttaaaactttaacaaaataaaacccagtgggaaaaaattttagaaaaggaaaaagagtacacatgtttagaaatgagccgtttggtttcctcgttaaaaatcttgcaaggaaaacccagtgggccaaaaccttgtaaaggaaaaagagtgcaacgcgcgttaactcccctgatgagagcatcaattcacatccttgagttttcacgttccaatcttgtgcattagcttcttgaaggatgacatccgtagagatttgatgaataaatcatccatattaacttcaatgaatatgttgcaccttgaaaaaatcctcactatcacattatcatgcttatagagagttgataatttattccacataacttttctcaaccgtttatcatctctcctcctcatgttagaaaaactaacttgcttcctcaactttgggaacccatctttgtgcattatggtgttaatcaaaatatataccgtacatcaataataataagatggaattatttgattcttgaccctgaaccagttgtgaggggagaatgtaatatacttttgtatataatgtatatcaaactgatatagataacttttgttatcataagcaatagtttagctattaagtggaggcactcaataaatcattttgctaaatcaactatgatgtaaaccaacttatcaagatgaactgtcttgaatagaaaatttaaaaattatgctctaaataaattattgagcaattacctcgcaaacactatgttgcgggttaataataatcgcacatgtaaccatctcatagatgcatcttatgtggtatacatggcaggtgaatgggtccagattcacctttgatatttccagcatttatgggattcaatcccaatttttagttggtctactaattaatgagaacaaacaacataagagaatttgtaaagaactttctagttctttaatatttacccatgtgtaattctcttttacttttgcacatcttacttgaattgatatggttaaaccaattatgccaagtgaataaattatcaatattgataaagttcagatttatactatgacgtgtgtatttatcaataaactccaagtttattgtggcattcttttatttatgtaggacaaattggagaataaaatgggtaacttttcacatacatattaccctgctacaagttgtagtaatagaagatattaaatctttcctttatttatagtctcaatataaccaaccgctttcgctaatactttagaactcaattatgtttctttgatacttactacaacataataaattgacatgataatcaattgtattcctccaaaatagtaataattggctctttcagagctctcaattaattttgtactatcacatattcatcaacatccatatggtgaatatctctttcaaatagaaagttataccattatggtcatggtcaaaatcattataggcaagatatgttgcttctattacttttgccatgtaataatcgcattgccaaaatatttggcataatcacaataggtacgtgatcaatgatcattcataccataataatgaaattattttcttatttcatctcaaacctttctagaggtgagtgtggtatattcacaatcactagcatgttcatattcttccaagaatgaatatttattcataaatcagatgttgtcacattcacatcatgaatgaaccataatcatctatatgtgctttacaaaatctcatgtcaaattgatgacaaatattctttcaaaagtgaaagattattttgagaattcttattattctcattatcacactgatgataatttcatctatttgccatgtccacatccattgatgccttcacggtaataattttgtcttctttcagacttatcacatattgctatcacattctcttaaaaggcaatgagaatgaagcaaattcaatgggacgggtttccacttttttgctaacaatcatacatgaatttgatcatggaaaagcatagaaattttaccactttcgggtggttataatctcttataaacttcaatagagttataatcaaaatttatgtttttgcttgaatttaaaatcaaattatagaatttcaagaatttaaaacagaaaaataaagtaaaatacttaccttaatttaatcatgaaggaagttcatggaataattggcaatcattatgctcaatcccaaagcttctactcaattggttagagtctcgtgctgataacgtgttatgaaataataaaagaggaagaacaatattgcagagaaagaggagagagaattcttattgaattttgggatgatttacaatggggtaagaccctctatttataggggaaaaatgacttagcctcaaagtaaaactctctgaaagatagacattcactctaaatagaattctatttataacaagtttaaaattttaggacaaaataagtactaattaatctctaaatagcatttctgaaaatggctatatgtgcacttgccccaatggatttagtaaagtgggcctatatgaagtccactttcgatgggttcttgctattaggagcccaaactcatatcttgcttgtccaatgtgtgagaaagcccaatatactaaacccattactcaccttggaacatgatttcgaaaaaagttaaaaagttttcgaaaaaaatgtaagaaaattcttatgtccaaacgggctcttagtagatttgtcaaatgaaaccatattttcccttcaaatatatattatagttcgattattttatgctaaccgtcaacctacaacaatccatctcttttatccaaactttagatatattctattgtttgcatagagaaaattaacacaattttccaaatagatgcttgcaattttagaaagaaaaaaatttatagcttgatttaaagattaagtgtgcatcttttcccatttcatgcaagaattaaagaaactataattttcctagaaaataccagagacaagtttatacttgcgaggagattatcctacaatgatttcaagttaataacgtggattatgaaagataaaaataaatttctcttaaaatcatccactatattaaaatttgacattaaaaatacgatgagagcttacttagtattgaaatcgaattagcagaaagtaccgaaagtcggctgcccgccctatatggaaatttgaattcaaatgggttaaaaatagatagtacataaatgggtcaaagcccattttctgaatcgtcaaaatcttctattgtctgcttccttggaccaacagaaaaggccaagttattgtttacactatgatgtgacaagacccatttagtcaaacaagattttaacaaaaagaattaacttttagttaaactaaaaatagtcgtgaatatataatataatctatatatactatgtgtataattagtgtataatttatgtatatcggtgaagaaaaataaacactaaaaccggccagctatttatgtaaaaatccctttgaacaaagtaataaatcaagcattgaatcaagcttttttggactctagtaatttcaatatgggctaaaatgtgaagaaaaggaacattaccaagttgaaatgaatcagaaaatttaaataaataaaaagtaagaactaaaagaattcacggatcattctttcatgtttaatttgagactgaggcgtaattattgaaaaactagcatgagatgatcaagttttcacgacattgacaacttgacgttagacaataaaagtaataatgaaatttcgagtgattgttgtattttcaagaaaattctcacaactgctaacaggcaagttgacctctgagttaactagaaccgattgcatggaacgaaaaggacgatcctaatcttgtgttaaaagtaataagttcagtcgaaatcacaaacttcgtccaaaataaaaaaatgtgtgtgcttttatttttttttagggtgggggggggtggggggagagggggggaggggttggtggtagtggtggttgggcaggggcctttgcagaaattttttgtaagcggtgtcgatatttatataagagtgtaaattaacattaattattatatttctattttctaaacgacaatagtcttagtgcattagttttgtgaagtcttaagttagaaaaagccttgaatttaattctactttaaactttaaatttcaacaaaaactcttcaaatatttgcaaaaatatgttctagttcaggttcaaaaatcccgaactcttaaagcaaaagaaagaacatcaccagtatgccagacaagaatacgcgtctagcggtattattttatgtttattatttgttttgacacgataattacatatgcttagtaaaatttccgacgaatcggtgtcgcgtgacaccacttcgtccaacatatatccgcccgatggtggtggtggtgtgtagggggaggggggggggttaggtactccaacaaatggtcaacttgttgggctaatgaccatctgacaaatcaattcaaagtgtaagaaggactcctagaatttgggctttttgcaaaaatcaaagccaaaacaaatatacaaaatgaacaaattttgaacccaaaaggaatgttggaaatgttctctacttagtaactcctactgtagcctactgtactaaaacaaacctatatttagaaaagaaagatattgttgaaattactgaaaataaataaagtaaaaaataaatttcatatctacaaaaaagtcaatagtaaattttataaaaagggtttcaaattcagtcttttttgcttctaaaaagacactttcctaattttacaaaacatcccctactcccctttaaaatgtgacataaatataggctatgacatatgcctaaattttttgaattttggggtccactttttaagactcacggactgcaaaactatagaataaaaatggtaaaattaaaaaaagaatgaaaaattagaagaaataaaaaagacaacaaaaatagaaaattctcgagattggagttataataaataatttctaatataacacaacacttaaacgttaaatttcacaaagtacttcctctttttgcatacatttatcactcttcacacccctctaaaaagaactggaattagttataaatttcgttttaattatgtcattaaattgctcgtaggtgatagaatttattgataatatatattatgtatgattagtgacggatttttctaattagttacgaaatttgtacgtcgctaattcggcctaatttttttattggacaatatattgactcttcagagtgaaggggagttttggagcaacgataaaattgtctttgtgtgacctatatgtcatgagttcgatctgtggaagcaaccactataattatattaagataggctgtctacatacatcatactgcttgaagtgcggccctaccccgaaccttgtgtgaacgcgagatacagtcagaccaatctataacaacatctccatataacatccatttaatgtaaaagtcaagttttttttatagaatcgattattatgttatgttataatatattctctataacaatacttcattctagtagccaaaaaaataggaacaaacgagactgtcatagagaggtttgaccgtatgtcctctataacaacacttcactacaatagccaaaatatataagaacatacgaggctgttatagagagctttgactgtatgtcttctataacaacgcttcactatagtagccaaaatatataggaacatacaaggctgttatagagaggtttgattgtatgttctctataataacattttactatagtagccaaaatatataggaacaaacgaggttgttatagagaggtttgactgtatgtcctctataacaactcttcactatagtaactaaaatacataggaacaaacgagactgttatagagaggtttaaccgtatgtcctctataactacacttcactataatagtcaaaaatatactaggaacaaacgagactgttatagagagatttgactgtatgtcctctataacaacactttactatatagccaaaaaatatactatgaataaacgaggctgttatagagagatttgattgtatgtcctctataacaacactttattataatagccaaaaaatatactaggaataaacgaggctgttatagagaggtttgactgtatgtcttttacaataattcttcactatattaaccaaaactggactgttatagagaggtttgactgtatataacaacacttcacacctcattataatagccagaaaatatactaggaacaaacgaggctgttatagagaggtttgactgtatgtcctctataataattcttcactatattaaccaaaacgggactgttatagagaggtttgactgtatgtcctctataacaacacttcactatagtagtctaaatatataggaacaaacgagactgttataaagatgttcgaatatatgtcctctataacaacacttcacaacagtagccaaaagatatactaggaacaaactaggctgttatagagaaatttaactgtatctagcatatcagactgttttttacggaattgattgttatgttatgttataatatagtcctctataacaatacttcactctagtagcctaaaaatatagaaagtaacgagactgttatagagaggtttgaccgtatgtcttctataacaacacttcactgcagtagccaaaatatataagaacaaactaggctattatagagagctttgactgtatgtcttctataacaacacttcactataggagccaaaatgtataggaacatacgaggctgttatagagaggtttgactgtatgtcctctataacaacttttcactatagtaaccaaaatacataggaacaaacgagactgttatagagaggtttcaccgtgtgtcctctataacaacacttcactatagccaaaaatgtactatgaacatacgaggctgttatagagaggtttgactgtatgtcctctataacaacacttcactataatagacaaaaaatatactaggaacaaacgagactgttatagagagatttgattgtatgtcctctataacaacactttattataatagccaaaaaatatactaggaataaacgaggctgttatagagaggtttgactgtatgtcctctataacaatacttcactacagtagccaaaaaatatactatgaacaaacgaaattgttataaagggatttaactgtatctaacgtatcagactgtttttatttttttataattatattgacacttcaggatgatgagtgaagagggtagattggggtttgaaaagtggacaaaaagaagtactactactagataaacatgaaatggtataaagagtttaaaaaaaaagtgcagaaacagagggtaaactgtattacaacaatagaatgtgacagtgcatgagattggcattatgtaggagaatagtaataacagtaaagtaaaatactcaatgggcgcgctttgaatgcggggcagataatactactcaaggacaatgtcagtctctttacacacccctttgctagtccttacccacggtaaaaaaatttagagtccgaaccaaaatattgtaaatttgactcaagagataaaaatagatgaaaaaaagttttgatgactatattatgtataacgcatttaaaatgttctatacctcaacggtcagttaccccaggggcggatgtatcttggtgtaagcggtgtcatcctataccgcttcgtcgaaaaaattcactaaacatgtataaagattaatatgtacaaagtatatattattaaatatatacaaggacacgaccatacatatactatttgctagctttgttggtcaagtgcttctactttttagagaggccctgggttcaaacttgagaagcttcatgctaagtaagagtttcagctttttctactataaacatgttttcctccaagtaggttccacggtaaattttcttactattttttttctgggggaagatgaagttggtccgaacccaaattgtaaagtcaaataatgaaagaacgtttaagtaattgcttagtgttatttatagaaaaagtagtatttactattatgtatagcaagaatattctgaatacatttcaaaaaatgaatatttgtcgaggagagttgtagtattatacttgaattcattttttttaataagatttgaatttgtattatttttatgtgtatcgtgacagtaatttatctatttgttcacttcattaaatgcgacactgcttatgtaaaatcctgcgtccgcccctggttaccccgttaagatatagcgcatgtaatatatacactgtactcagtatttgcagccataataattgactgcatagcgcatcaattatatgcgctataattgatgcgttatgcattcaattattatggttgcaaatactgaatatagcgcatatattacatgcgttatatcttaacaggataattgaccgttaagatatagcgcatgttttaaatgtgttataaataatatggttctcaactcttttctccacttatttttgccttttgatccaaaatttacaatattttgcttccccacacaaaaatttatccccatccaacgtttatatcaaattaataaacataaaggcggattcagaaatttgcttttgatttattggatcaaaagcaaataatttacttatttaatagttttcttaaacatatatacaaaattcaaaccaaagtaactaagttcggatgaacctgtaattcaccctttatatccgcctctgaatgaatgcaagacgtgtgtatatttacacaaatattttcactttaaattttaactgatacattaaattattttattaggtgtaaacgaagtacgggaatgtattttcccttcatccatatatatatatatataaaatttgtctaatacatgttatgattaaaataataaggacattaacaaactgtaattattccatcatatataattttagggggaaaaaagattcttggtcaaaagaggcaaagtgaatttcagtacatggtataataactacatgtatacataataaggatattttctacaatttttttttatttatcttaagtcacaatcaaaagtaaggggaccctaaacagtaaattgtcaataaattcaactgcagagaaaccacaattctattctctcatcatattgccatcatagcctggtgctttaactttttagtcactgaaaaagtaaagtgaaaatgaaaaagcttagtaattaaagccttttctttcctttccttcttacttttcttttcctttctttagttggagagtgagagaaaggagtatacttaaatatttcttgcttttttactgattaattttaagttatgcagtagttgtcatcaacaacactgacaaactaccggtattatctcacaccgtaagctctaatgaggttagtgtgtacgtagactttactcttatcttatgaggatagagaggctttttttaatagagtctcgactcagaaaagtataagcaccacattaagagacaacacaaaaaagctatataaaagcatattaaaacaacagatagtaaggtgatcaataatgaaaacaaacaacggttagtcataaaaacctactaccagcagaaagcgaggttgcgtgccaatacgactgttatgaacactctagactacctattccactaccctaatcctccacctatataccttcttattaaggatcatgtcatcggtcatctgaagctgcacgagtcatatttatttgttatagcaagtaatatatactcattattttcaagattataaatctcgtattttaataataatgtatatagtgaaatttcacaaatagtatatggagaagatatgtgtacacaaactttattccaagttaatttgtgcagataaagagactgtctttatagaccttcagcttaagaaaaatctcatattgtaaggaaacttatatatttttgtgaccaaatattgtaatcctttttatattaacaatatatatagtttaaatattttattaatttagtgtaaatattaggtaggaataaaatatttaccaagggataataggcagtgtgcagtaggagtatgtgtatttattttctttctcttcaatcataaagcaatcgattacaaaatgattttactttctttcctctcacatccatctatcctttctgctctctgccccaaaaaagttctgtactcttctgcttccttttgcatttattaccttctcctgtcttcaacccccccctactacacccccaaccccaaccccacccaccttcttgattcatacattattcaacccctcttttcgaggaatgggccatctagggttaaacatcctctttaccccgccccacccacaccaccactactaacatcacactgttctctcatatgtcaacttctagtggatataattttgtttgaacctttgtacaattaaagtcgtatccgtgtgacgtataggtcaggagtttgaatcgttgaaattgtcgttgatatttgtgttagggtagactgtctatattatattcttggagtgcggtccttcctcgaagctgaatacggaatattttatacatcagagtatcagagtgtcctttttttataaattattcgtgcgaagaattttacgcgatctgatcacttataggaaattataaatagtgtagttatttgtagttacacgattactccctccgtctcatattatcagttgtggttgctaaaaatagttatcacaaattgtttgtcattttagaagttcaaaacaaaattggttgtttttttcatattttacctttagtaataattatcctcgaagactacaaacatcacaattatgatgaagagagattatattctaagacataaataaaggtaaaatagtcaaaacctattatatttaatattttcttaaaggacgtgtaaataagaaacacgacaaataatttaagacagatcgagagagtaattaatatgatgattatcaactataacatgttaaaatacaggcaacaataatttttttatactgataatataaataagtttaaattaattttttttagttacaatacaaattaagcaatttagtaagatgatggagatataagactttcatttaaatggtaaatttggctcttttaaccattttcttccagggaatgggattaaacctaagatgtctttaatttagcaaaacatgatcttcatatatcatattgatagagtttgtccaacagattctaaaaaatggtcactgaattgcagatatggaccagttttaaccattttccattgaagggttacatcattgcaatttaaactttacaacttgtttggatggtcgttacctattctatcgtatcgtattattacattatataagttgtttgtattggttgttacttaaattttattgtatcgtatcgttaaatccgtcgttacataacaacgaaatgtgccactttatgtaacgaccgatttggtgtggttgcgtcgttatcctgtctttttttctcatctcacccttcactattattaaattattttattttatcatttaccctatattttatataataatttatcccgtatcgtagtttttctttataatattgcaaatttattcttcatattactggtgcacgatatcatgaaacaacggcaaacgatataatctattcaaacgttgtatttatcaaacaatacagtacattatgagacgatgtgtaacgaccatccaaacaagctgttagtattatatagggtgttgagtaacaaatatttcaaataagtgcaaatatagggactcccttttagaactcatattattttaagttttaccaaatgatgatttcgtatttcatagtaatccaaattaaggtaaaaactataagagaaaattgaaaaatgtatgactcagtcaataatggacatattaaaacatgatcaagagaattaaaatgaaataattgcaagtaacacgtggttatgggttttgagggcaaattgggtaaacacaaatcagttcctatttttatttttatttttatttttatttttattttatcagttgagaaatattaagaataaaggaatatattgtacaacaatcaaatgtggtattctttcaacctcaatatattctcttgtcaaaagggattttgaataaagaaaagtaaaatacttagctgagtctttcatttcaactttattaaccctacattgtcctaatttgtctcccaccacccccaaagctaaccctacctaatgtcagagccagaatttaactttatgaagtctaaataatctctttttttagccgagagtctctcgtaaacaacctttctactcacagggaattgggtacgtaaggtcccctactagttgaattctactggcttgttgtccaggacaaagccacactttggttagggcggtcaattgactaccctttgtcggaaaattatacagcatatatagataaaatattaagttttagaggtacataacatatattgaacactctttatcgaaactttttttaacttatttcaaatcagaacacccttaagaaaattcttacattcgccactggttgttgttgttgttgaactctaaatataagaatgacgatttcaagcattaataaaggaattctaaatttaatatacgtatatttaataaatttttttaattttggacaaatatttctaaattcaaccgaactcgtatctgaacttctagctccgctcctgaccccacccccaacctaaattgtagccttttcaaagttgaaagagtagtctcaatcttataaaggatgtggactcttccctccccatctcgagggctattttttcctagaggaagtaaataaagatgcatttatgagacaactaactttctctactaacttatagatgtgtttaatgaagcatatcataaaagtgtgtatatgaacctaataaatagtactataacctataataatataaagatagctaggtctcattgatttttctttgacctataaaagaatttttttcttcttcgaatgattttttccaacaaaaaattaacggtgaagtcaggaatttatttaagggtgtttaaatttgaaagaagtgaaaaaattctccgaaaaagaatattcaatatatattatatacctctgaaatcgaatattttacctatatacacagtatatttttcctacgaaggatgatcagttaaccaccctttataacatgtagcttggcccatgcaaagaacacttacttctttcaaatatatttagcaaaagtgataatattagctagaggtggatgtgtaattttgaaaaatagtaaaaaaagaaaatcaagtgaaaataatatttaaaaaattaaagttgtatttgggtaggaatataatttagcaatgttttgaattttgtgagtgctttgaagtgaagattttaagaaatagctttttggagttttttaaatttttaaaaaatttcgaaattccgtttcaagtaaaatttaaaatttttatgatctgacactgacttcaaaaaaataaaagaaaatatcaaaaaagtgaatttttttaatggtcaaacgggccttgaatacttcctcagtccaagtttatttatccgttattgaacttgacacattccttaagaaacaataatagtaacatgataattttactatttcgctaataattattattattgaaaaactttaactattataaattcaaaaagttagaaaatgaaaagggtaaaataggtataaaataaaaaattatccattggttttcccaactagacaagtgaaaatggatatctatttttagtatagtggacaagtaaatttggacgggcgagcagaattagtttccaaaaagcatcattttatggttttcattagatggttaaagaaatatgaatatctaaattagagttagtttttaaacttcattttctaaaaaaaagatcttttttttttcattttaaataagaataccaattgtttgtccttttttccccagccttctgtccaaatcttttgggccatatttgagatcttttaagctttttttaaactaaatttcaactaatttatatctctacaattaaggaaagaataaatgaaaaaagaaaaaaaaaaataaatttcaacaacgctgttttgcagtattcatttacttgagcataatgccataatatcattatttaatattttctccttcaacattattaattcaacacacttaaaaataatggaatatattataaacaaattggaaaaaatatctcgagtattctagatttgtctctatattattttcctgagacaaacaaacaatgtcaaacatacctaactgcagtgattggagcttgatattggtctatttgtctgcatataaaattgtgaaaaaacaaatatatactttaaaattttctgattattaatagtaagcaaagagaaaaaatacaaaaaaattcacagtgaaaatctaattattgtctgaggatttgaaacatcctctgccttaatactgttatccttccttccaccatgaaagcaaaacatccttcatctccaaccccaccaacccattacaagaaaattatttaattaattaattaatacttattacattatgaatagaaattatgttatttatataaatatattctttgatttaattttaattatctagcttcagtgtgattatataatttataaaagttcttaaactgtactatcatatatgaaaattatatgaagaaagtacaaatttgttttcttccccttaaaatatcaaatattaattaggtatttccccatctcccgaattcaaatcttgattttagttatatgcttcaacaggggcggacgcaccttgatgtaagggtgttatccgacactgctttgccagaaagtttattaaatatgcataaactattaatatgacaaaatatatcttaataaataagaagaaataacattactttgtatatacatttcgctagttctcctgttcaaattttttttttaaggagtggtcctggatttcaaacttcggcagcatgccgagttaaattgagtaagaattttatgcgtcttcgtttgtttttcttgttgttattgttggttacttcatgtttgtgtttcttaagccgacggtctatcgaaaaatagcctctctaccctcgtaaggtaggggtaagacatgcgtagacactaccatccaaaaaccccactcgtgaaatttcactggatttattgttgttgttgatttttatgcgttttttactttaaatgtttattatttgtttatgttttaaatgtgacaccgcttacaaacaattctgaatacgtccctggcttcaaaagaacatcgaaaatgtaaaactgatttagggtcaaacaaatcaaatattttcaaaaaaaaaaaaacacccaataaacatgatattttcgaagagaggaaaaatagagaaaattatattaaaataagaaagaagataaacagacaatttaagcacagaaaaaaattggaaaatgaaagaaaaatataaaatgaaataatgaaaaagaaaaataagcaagaattatattgatttgacggtgaagctgtaaatgtaatagtcaaagcataagagtatgtgcagaaaacatcaattattcttctttacagtgaggttttatgtcaatatagtatatatagcatagtgtataggtccaactttctactactaccatttgtcaagccacctatttaatgtaataaaagttctacaatttaatatacttttaaattgttattatataatgttgaatgacatttaatcaataaataactatacctactaactaggtgcaaattaaaattttcttactactaacacttcatttatctttctctttctgatttgggatttgcctaaagttttatgtgtattccctctttagaagcttgcggcatagaagcctattagtgttttttttcactcaccttattggaccgcatctatcagagaaaaaagaacgaatggatttgtcgaattcccaagaaattcttcgatttcttccggaaacagatgatttaatcatctgcttctcacgttccgtgaatagtcgggacattgaggaatatccaaaaaagcatttgggaatcggcctttttatctcttttcattccatttgaagaaaagtaggattccaaaaaatcggtctttcttttcgttgttgaatctctctttaattaatcaagtgtgatatttcgaattctcgttactaatggaatccaaatgatatatagattgatcagaagattcttttagttggctagaatcatatttttgtgagaaaagattaatattttcttgtttttcctctatatttcattaatttgtttttcattagtaatgtgaagatcaaaatggtaaaataggtcattgaagttaagatggctgcaaaaggaaggactaccttcccatcacaggtcatgtgtgttcatactatcactgtatggtctattatgatgatatgattagtgactctttgacatacaattgtaccatctaacatgaattttgggatgttgacttctaactggggatgggaatttgagcccaaactcatttaactcgcctaaacttgtccaaacattaatgggttggattataaatatttagctcatgcgttaattttgggttgagcccaagttaatcaattattttttggggcttttgtatctatattcgttttatgggtcacgttttaatatacccacttttaaaaaaaaattctaacgtacccatttttcgcataaacttcagcatacgagtttgaaatagcaaaggcaatcacataaaacttcagcattctaggctttttcaaaaacttcaatagaagtgctgaagttatttagttcattagtaaaatttcagcattaaataagctgaagttttgtcttggattaattagttttgtcataaagctttttcataacttaagtagaagatgttgaagttatttagttcatttgtaaaaacttcagcactaaacaagctgaagttttgtcttggattaattagttttgtcataaagctttttcaaaaacttcagcagaagatgttgaagttatttagttcgttttcaaaaacttcagcagaagatgctgaagttattaagttcatttgtaaaaactccagtactagataagctgaagttttgtaccggattcattagttttgcaaaagctttttcaaaaacttcaacaaaagatactgaagttatttagttcattcgtaaaaatttcagcacttgataagctgaagttttgtcatgaattcattagttttgcaacaaagctttttcaaaaacttcagcagaagatgctgaagttatttagttcatttgtaaaaattcagcactaaataagctgaggttttgcacaggtatcaggaaggcggcgctgaagttgtaaaaattagggtataggtaaataattttaaaaatatgggtataggttaaagggcagaccaaatagggcgcctacacaatttttacttattttttgtaactcattctgacccattaagcagcccaaatacaactcatgaaactcacccaaaacaaagggatctcaacccaacttatctagaaatttacttagttgcctaaatttcacctttttttgtatttttaatttttaatttttttgtttttctgcaccacccacccctaccccctacccctaccaccaaccccctccccccccggggcgcaaacccctaaaaaaaatgtatttttattttctgtttttttaatttttctgcaccacccccacccctaccccttaccaccaacacccctccccccggcgtgcaaaccccctcaaattttttttacttttttttgtatttttattttctattttttttttgtttttctatactacctcaacccccccccctcccccgcacaaataaccccctcaattaatttttgtatttttaattttttgtgtttcttttccatttttctgcaccacccactaaccccaactcccctgtgcaaaatattttttatcttacacattttaaggtaaaagtcttttttttgcgagatgagcatggttctaaaatacgggtcaaattgggcgggttgagttatgacccattgtttagctcatcttgacccagcccatcttagcgcaagtacactttgggctgagttgggcaatgacccatttattgacctaacccatgttgatccgtccaaattcagcccaacccgtccatttgcttcctctacttcttaccgacgttggatgatatatgattaacattttttaatttggggtgggggtggggggtaaggaaaaaaatgttatgcactgccgagcgtgtggtggaatgattgagaatccttcactcttaactcatgagatctcgagttgaatctcgggaatgaaaaactaatcattaagtgtattttttttttacttcacattcactttacggatctgaataggtctgtataattaagatccctaactgagatttaatttcagtaagatgctatcaaccatattcattattaattgtcgtcgctgtctaccattgtcaaatactaccatgccaccaccatactcaaccactatcaccaccatcatcctcaatcatagccgtcaccgcaatcgactaccaccattggccatccgcaccactcccccaccatcattcttaactacaaaaattcatctacatcaactaccacaactaaccatccaatcaccatcaacaatcataatcggcactactcatcattataaagtaccaccacccaccaccaccttcctcaatcacaattaccaccatcaccacccgtcattattaactatcaccagtcaccaccaccatcctcaatcataatcgcaaccacttctaatcaccactagctactaccctaaaccacaaccatcaaccaaacctatcacccaccaccgcctctagtcagcattcacaagcaccaccatcagccatcaccaccagcaacgactataaatcatatattttactcatagaatattagattaattagtatttcatttaaattttatgtttattaattttcaaataaagataaattttatatattcagatattaaaaattaaacagtgttaatcatttaatatttaaattttagtacacatcttaaaatcagatgtgtattcagatataaatgtcttaatcttaatacacatcttgatattcagatgtgtattcagattcagacgtattaatcttaagaaaaaacaaataggcctaagattttttcactaataggtaacctttcataatgattaggattattatcctagaaaataagtatatatatatttacccaagaaaagttgggggtggtggatgttggggttggagggagggggatacttatgttatactatatccagtatgagtctgattattaagaaaagacagatataaaaaatattcctccatgcaaaaagcaaaaaggaaagcaaaggaaagaaaggtagcaaagcaaagatagatagaaaagtgagggccaaaggcaatactatcaatcaaaaagagatgaataatatttttcctatctaactttacagaaagtgataattataattttgctttttgaggggggcacaattatatacttagaaaattcttttttatggtcatctttaatgaaaaatgaaagcaatatatgttaccaaagggagaggaacacggaccttccaaaaagtacctcttggattttgggaatcacgaaagttgatttgctcatttcatcaacctacctacccaaccccgtaaactacccaccccacaactataggaataaggggtgaagccagagtttacgtttataaaaggcagacaggtacacaaagtattttgtactcacataaggtccgggaaagacggcaacgtaaggagtaatgatgtagacatgctatcccattgtgaaccactaatgattgcttccatagtatgaacccgtaacttataggtcaaacatagacatctttaccgttggatcgcaccctaaggggtattgatttagacaagctaccctaatgcgaccactttcacggttcgaactcatgacctataggtcacacatagataacttcatcgttgcttcaaggcttcccttcaagagtttacgcttatgagtttggtcgaattcagtaactctgatctaaatttgatatttgttttagaaaattcattgaatatataaaaattattaagttaaaacctaataacttagaaggactacaatctccaatatataaattttaaattctgattcctcatctgaaaatatatatatatatatatatatatataatatatatatatatatatatatatattatatatatatatatattatatatataaggggtgaatatctatatgtttcctttgtggaaaaaagaaacaagaaaggtgtggggtcaaaataaaaagctaaaataataaggactatattgaggggaacagctggtgagaccataaatattgggaaggtcccattgagaatgttgcaatgtgttttttgataaagaagaagaagaggaggaggatgagtgagagtcaaaagatggggcagaatcataggaaactttcaatctcaaatatattctttcactttggttatatattttagaaaaatatttagtatacagtcaaacttctgtataacagtctcgtttgtttcgaaatctttttgctattataatgaagtgttgttatagagcacatattatgacataatataatattcgattccgagaataactcggcttttataatgaatgactagtattatatatggatgatgttatagagaggtttgactgtatttcataacgtatttgggaagagaatagtttttagacctatattgctcgtaagctttaaaaataatattgtaatcatatcgaatccttcaaaaattaattaaatggcgaaggttctcgaatcgagttacgactgaatagagcgatgaaccaacaagttcagtcgaacaaggtaacgagtctcacttctgatatctccaggtcttgtcaccaaaaaccttccccgattgacagaacgttccgctactgacacttgaaaaagcagtttcaaggtctcgtcgaacctttctctagccaagcagtggcggagctagagcttcggatacgggttcggccgaaccctgtagctttggtccaaactttatatttgcttttaaaaattcattgaatatgtataaattattaacttagaactcagtaactcagaaggaatagaatcccgaacccattaacttcaaattctaactccacctctgtagccaagggcagaggcaaatcttgaactagagatactttattctaaattttatcgctaatatatacatagttcgagcaaaaaaataataattgaactcacaaaacccgtcttaaatcgacgatttaattagtgggatgaggtaggtggacggaggagggtggatatcccatgcatgcatgcatgctagaaaaataataatgatatggtgaatgtttagtttataattggactgcatttaatttaatttaagagaaagattagatagtgggaacaaaaataataggtcatgtgacaatatcttttctcacgtgacatccgggaatctagcattctttgaaaaccctaagatcaattaaataatctctatgatagcaacttatatattattaagaagaggagtgacatatttaaaatattcaaagttataatatgtacgttgaaaacagtcaaccacaaacttttttttatgtatagtcaaacctctttataacactttcgtttgtttcgaatatttttgaatgttatagtaaagtactgtaatagagaacatatattataacataacatgaatattgattccgaaaaagtttaacatttataatgaaatgttgttatatagggatgatattatagaaaaatctaagtgtacgctaattttgacgatgaaaagttactgtgcatattgatttatggagttatctctacaaaaaataagcaaaacatataagcataagaaaagagaaaaataaagcgataagcttatctacttccttatgacacgacttagagtccgtttgaattggcttaaagaaaatatttttcggcaaaaatgtttttaaagtcaaaaagtaataagtcggggttgaccagctgattgctttgactttgttttaagcagtttttaacttatttaaagtactttttaactttaccaaatactgaaaaagctaaagaaaaaccgtaaaaatttatctgtctagcttaaaagcgaatccaaacaccttcttagtcaatattctcacagttcagataaaatccaaacctctacttatgaatttgaggtttggatcacatcaaaaagttagtaatttgagtcaatataaaggtgtctaagaatcataacttatatcttcttatagggaaaagttgaaagagatcaacataagaagaggcaataatgtcccaccttttcttttctttttgtgtccatggacaacatcattgcaccaacaaccaaagtaaagtttatcaagaagaagtgccgcaaattgataaaggttcttttacctttaatacaacgtttcgagttcaaacttgagaataataatgaaatttctcgctaaaactttcaataatggactttctattcaaaataaggtttgatccttgctcagaaaaaatgctagctgtatacttaacacatgcaagtccaacgttgttttcggggaactgaccagaaggaaaagagactcctagctaaaagtagtttgtctcgcccagaaggctagaagagttgagaacaaagtagcgaacagctgtgtagcgcgtagaaatctatcgaagagttcgagccaaaccctgaagaaagctaaagaggcgccgtttgatgagcctgcatagtattaggtagttggtcaggtaaagactgaccaagccaataatgtttagctgatcttttcggatgattagccacattgaaaccgagacacgacccgaactcccactaaggcaacagtactccacaaatttaaattaaacggaccaaagatttcgaacgtcaaaaagaaaaattatatagggactacgaggataagcactagcttttgttacatagaattcaaatacttctttttggcttgttttcataggctttttccctttggccaatacaatccctttttacacaatttcctagtagtaccatagtttcatgtatgaatgcccttttctttgtaattatgagaattttttgatatcgtctttcctccattggtgttattactttctccgtccgtaatatgtgattttttggttttttttttgtggtctaaaaaaagtgatttttttacattttaataataaattaattatttttgtctacatcgcccttgaagtaaatagtgttggagcatgtgttaggagtgtttatatgaaaagatagtaaagattaatatgatcaatttcattactaattaatcttaaaaaataaatttcttaataaatgtgaatacaacaaaaaaaataattattttagaccagagaaaatattattttagttctttataggtgacatgatttgatgttctattcaataaaaatagatcgaaagcttataactcttttcttgtgtcaaacgtgctttgtagactaacattttatgcctcatacgagggaaccaatgttgttgtgtattatagacaatacagtagtttaacatgaattatttttgcagaaaaaaaaagatttatttattttatgcttttttgctttaaacgaagtttgcaaaaggtaattttcatggcttaaacttatgaattacaatctcctaatcacacaacgacaactcttattgttgttgtgattctcttgtaattacaagaactttacagcttgtttggatggttgttacctgtcgtaattgtatcatattgttactttaaatacaatgtttgttttgattgttactttatttttattgtatcgtatcgttaaatccatcattatataacaacgaaaagtgctactttatgaaacgacagatttgatgtggtaaagtcgtttctttgcttttttttctctcatcttacccttctttaatattaaataatcatattttattctttatcctactttttaaataataattctactccgtatcctattttatcttagtaatgttgcaagtttattcttcatattgttagtgcatgacattatgaaatgacggcaaatgatataatctacggaaaaggtccaaatatgcccttgtactataggaaattgagcacatttgccattagttaatactttagctcatatatgccattaccgtcatataattggtccatatatgcccttaccgttacatagttgatccatatatgcccttaccgttacatagttggtccatatttgcccatttttcgaaacggaatccatccaaactaattagatctttatttaattgtattaaagtgtattacaaacactctctcctttttattagtacttttattttcttttacctttctcttttctttctttttttttttctttttttttcctttttctttctctcatatccaatttcctccgttgtcgatgccttctccattttcgtcaccaatttcatgtgattttatttctaaaaatcaaacctacaccacaaaaacctttcaagagagaaggctctggttcttttgaaaagaaggagatgaaaattgtcggaaatatttttgcggtggtgttaatttggcgatggtaggatatggttattcagattttaacggtgttgttcaccgtggagcttcagatctgaagggaacaagaccatcaaaatcagaataaccatatctaccttcacccaattaacaccaccgaaaaaatatctccgacaatttccatttccttcaggttagaagaacctgtggggtttgtgatagtaaaattagcaagaattcatgagttttgacaagctaaattggtgacgaaaatggaaaaggcatcaacaatggaggaactcgaacatgggagaaagaaaaggaaaaaagaaagagaagaaaagaaaaaaaattttaacaaaaaggaaatagtgtttgtaaatattttagtacaattaacgaaagagttaactagttcggtgaattccatttcgaaataggcatatatggactaactatgtgacggtaagggcatatatgggctaaagtattaacgaatggcaaatgtgctcaattttgtatagtacagggcatatttggacattatcggtataatctatccaaatattttattcatcaaataatacaatataatacattgcaatataatacgatacattatgaaatgacatgtaacaacaatccaaacaagctgatttaatatggcattacagtataatacgatacattatagtttttactaaaaaaaataattattaaaaaggttttttttatagtaaggagaatttattatttaaaaactaggtactgacaaagtcattacaagccattctgtgatagatcacgtcgaactgaagcacttaagaaagaagctgataacttttggtttatttgatacttattctgacatggtttataaggttacaacacagacataacctggaaatgctctaccactatgactccaccttttctttcatacgatcgtccttcagaattacagggcaaagatgatttctgtaatgaaggatctagacttaaatgggaccaagcaaagacaattatatacgaggaagatcggtccacttacaaaaatatctgaacgagaagggatcagtgctgtcaactatgctcgttatcagaatggttataccatggaaatattggggaccatctttcaaaaatgaacctgtacgcatttcttgcatggccgaacccatagatcttgatgtatgtctattttttacttggactataaaaatgcattcttagagaaccccacggagcggtactcaaattaagactacaatcgtctaacgtggcatcaatattaccaagtgctgctaagttgctgcaaacattaagagagtagttttaactattacaacaccattttcgtcccccagcatcctggactcaatgaagatgggtggcttatcataacacacaaggttatttatggtggttgataggcaccttcctttgccaaaagatgagctgttgaattgccttctctgcaactatgtttgaggattacttgtccaacttgctcattaaccatctgcagtcaaaaatgagattattgtatgtgatgtatcctttgtctaggaggtgtacaaactacgtggaatcaattttcacttctaatggtgtaagttggtgattagctacgtatattaattcttggtggatggctaaaagttcatcatgggtaggtgaaactgcatggacggaatccatgaatcctagcttccattttgcatttgcatctctgataagttcaccaatacctgaaaggagttagtgcttgtaaaagcaccatcaatattaagcttataccagcctctagggggagggtgccaggagatgtgtatgagaatttttctagacgagttagtgacttttttcgaaagatatctatattctaagacacgatggagaattaggaagggtgggaggaaatggtttgcgttattaatattgttattgtttctagtgagccaaaggttccaaacaatgaagggaaagagatcaaaccaatttataagtggaaggcgtgtcttgagttggctattaatagggggttctaatttttaaaggagtccagccagtgcttattattggatttaataacgagggagatttcttatttaagaaaggtccaaaacctttgtgctgtaggacagtggaggatgatatgctcgatgtcttcttcttgattgtgacatcatgtacataatgagtcaatgttcattccaatgtgttggaggtattttctagttggaacccgctcgtgataactaagccaaatgaagaatttcattttgttggggcagttaagagcccgtatccaattaaagcatttatctgtagggatatttgtatgatcatcaagaaggttgtaacacgatttggtagtaaagatgccgttagaagtattttcctagtagatcctatcctggaggttactatatgtaagaattaatgagttgattctattggcaactgaaagggggatgtcgaaggatattttgtctagatcccaagagttattgtgaaggaaagctctggattgaggagtatgtcacttttattcaagggacctatgagtagttgacgaagcggggacaattagggatccaactatggttccatatgtcaagttgagagttgggcccaatagaccatgaaattcctttttagcaaattcctcaatcaaattggagactcttccgaatgaaggagggatttttggctgtgttgagaatatatttagagatgaggaggtttgcccaaggggaggtgggggaagataaaagtctccaagcaagacttgcaaggagagttttattttttagagggctttttaaatgccttgcccccctccccccaagaatttctctttggtaatagtattccaattcagaaggtgtaacttttttttttggtctgtagttctccagataaaatttctaatgattctatctatgtggaggataatccagctaggaagcatggtaaattgcatgatatagttaggaatactagccgggatggattttgcaaggtagtgcgacccgcaatatttaaaaagtttgttttccagctagcttatttgttccttaagttatcaaggatgtagtaaaagtccctattgatggggcgcctattatgaataggaaaccttaggtattttccaaaagttgtagtactttttatcccaagatagtttgatacaaaggtaatatcatctctaaggcagttaattgtgaagtaaatttcagacttagtatagttaatattttgcactgaaaaattacagaaattgttaaggcaagtgaggatggtgtgacagtttgctttggtagctttgcccattaaggccagatcatcagcaaaaaaaggtgagatataaggggacaattaggatttattgtaataggatcccaaaggtgagtatcaacaagtttgttgatgtaccgtgaaagcatttccatgcacagaatgaagagatatggagacataagatttccttgacgaatgcccttgccggggctaaagaagttagttcttttcccattaactaggatggatatttggctggtggttatgcaggacataataagcttgacaatattaggagaaaatttaaaatgctgaagagttaaatagatgaaagaccattcaattttatcaaaagttttttctaaattaactttaatgatcatgttgacaatcttactccttttttattaatggagtggataacttcctggatgattgtggcgttatcactagccctacgatgtttcaaaagctggctaggtacggactatgatattttttaggaaaggtcaaatacaattggcaattattttagtaatgagcttgtaaactgtttacagagacctatagggcaaaaattcttaagattattagcgttgggaatttttggaatgaggcaaatgtaggtgttatttagaggagctggcatagtatagtctttgaaaatcttgtgacagaaagagattacggaggggccaactatgtgccaatatttttaaaagaagaagggtggaggccatctggtccaggggctttaaagggtttaaatgaaaaaagggcattagtgatttctatgttggatcagggtttgtttagtgaggatacattgaggttggagaagctagtggggttgtttctaataaattttcaatttgtagaagtcatagaagttgtgaaaaggttttgaaaatttttgtgatatggtccataatatcctactatattggttatcaaaacaactaccctgatcatctttagaaaagacaatttgatttttcttctacggttagaagcacaaatatggaagaatcttgtgttagcgtcgccgtcatttatccaattgatcctggacctaagcttccaataatcttcctctatttggaggatgccatcataatctttttctaagttttgaaggaaagacccagagtgataattaccagatacttgaaaatgacggagtctagcaaggtatatttttttccttctaaaaagatctccaaaggtactatttttccaatcaagaatatttttctgaaatacgctggtggcattaataatattatttgaccagctagaattgataacattaacaaattccggatagttgcaccaaaatgattctagtcggaatggtcgctggccaaatttagaattatggttggttagagtaagaagaaggggattatggtccaagtaagtttttgggaggtgagtcacatcggcatttggaaaaaaatttagccaattgtcattcacaaatattcgatcaaggcgttccatcatcagaccttttgatttttttctatagttagacaagggaatttacatcctttgtaaccaagacctattagattacaatgactaatatattttcatagtagagaaattcttctagggtttatcggtctcccatcaaacttgtcactatccataaggatgtcgttaaaatcacccccaactacccatggccctctatacgatgaagaaaattgcataagagtgttccaaagattattcctattagtaatactggtactagcataaatagaagtaaggagccaagttttttttgtaaaaattacctctatcattacatggatagcttgatcatgcctagtgaaactgtgaacattaacagtgttgatattccaaaggatcaccatcccacctgcttgaccctctgcagggacctcgatcatattagtgaagtcatgatcatttaggagagtagtgtgtgaggacattctggtctccagcagtgtcaaaacacaaggtttatgagtgtccattgagtccctaaaatgcctacgaaacgtgtcattgttggctcctcttacattccatagagtaatacgagctagtttattcatggttgggactgttgggctgctcacatgccttccctcctctggagagagaggtggggttctcctcatgcatgtgactagaatgaccgcatgcttccctactgtaaggtcctgggggttgaatgttcatggagcacttataaagttccatcggacagctgaagttgtatttcttgttctgcatttccatgaatagtaatatttacttctcctagacttgcaaattctactgatagttcgtggtggattaggtctagttcttcctcctctatctcttgatttggcacctgtggtgggtcgttgggtggcatattcatttgcatgggggctgggcattttcctgaggaggtgactgattgaggtggggttggatctcccatggcaatatggggttgagagtgttgggtttttaagcattaataagcttaaaataaggtgaagggaaatggagggaaaaataaaatatttgagtaatatttgagattccctccttgattatcccatatcggaagaggaaaagatttttgatgggtatataagcaattgctcttcttttagctcttaaagagttgagaagaaggcaagcctcgcgccgtcgtcgtcgtcactcggcttcgacttcggcttcggatttggtcaaatgatcgattgattaatttttggaccaaatttatttgttaatattaaatattaacagaaatattattaaatatttgtttaataataaatattaatattaaatccatttcaggtattcaattttcagttttctgttattgtaacagaaaattaactacccttcaattttccctctttattgttgagtaaatagccaattatgtcatggcatttattctatgggcgttttgcaaatacagcctcttcagatttcagcccaactttggctattaatacaagcctattctctcagattttacatactaatttctgagttcttctacttccttctgcatagttttacttcaaagaaagcaacagtaagtgtgatttgctatcgaactttgtgttcgctgaaaccctggggtttgaagtaccactacaccagtgtgtaattcgttctatcctgggagaaaataatccttaaccttgggtactaggagggaattaaattccttaaggaaacactgtgaattcagtgggctcgaattggtttttcttatttcatttacatttctgtttaagttatttattttattcataattgttgtacaaatatagagaagtaacagagagttgtctgttttccggtgggaagaatgagaaattgggttgtggaaatggggttgtttgtggaggttgaagaggagaaagattccagtgattctgcatctcctagaccagattggggttcaagtttggaacaaggggttgaagaatttggtttagccatatttgattcacataatagttcattgctagatatattccttccgtgactaactgggctatgtattgaggattctggattatgaggattgtttcttggccattgatgatcatgttgaaggagattgcatgccccatgagcccatttccaaccaagattgaggttaatggttcggaggatgaggaggaggggatgtatagtagtgaggggatttggtattggaaggggaagtttgttcatggttgtttagtgatgatggtttaggatttggatgagtctcaaacgtctccttagagatataggaatccttggcataattactgatcttgttgaatggttactttttgcagtaggtataggaagttctatacttatagcatctgtgggcatgctaaacgattgagaagacgtggaaaggttagcaaaatattcaggcaaggttttgcttgatctttgtagaattgcatgtggcacttggctagagcatgcaaggtcatgtgacaattgtagaagattgtgaaggagaagatttacgatgtctactgtttttgcatgcatgcagtgttggttgatatcatcgaggggggttatttctttatatggggggtggggggtgggggggggagggtcggttttagaagaatgagagaggttccatgtcagactccatgcaatggtccttgttggagtcgtttccaatcctagaggtggtttcatcgttaaccatcagctggatgtgcagagaagcgaattggttcaatttgttcatgaatttgaggtttgggtctgccttgggggaaggaatatttgatttaatatgacaaaatttaaaatatttaaaagaaaaaattgacagaaatttgtgttggagtgaaccaaagtgaccacagaaaccggagacctatacctataaaaaatagccaaacaagaacaaatttgtctaatgatagaatgccaattttctgttcatctccaggagtatttttctgtgaacaggtcttcttcatagttcattgtactacttagaatattctcctcagaaatttaaattataactgtgctcgaattaattaaataaatagctaactaatatttctaaacctttgatataggtaaaaatcttatttcacgtcacaatttattttcatatatttcttttttaatttcgacagccttttttttttttttttttttcaatatttgaattcaagacacttgatttatgatttcttgaaatttaggtattagtttttaagaaagtacgtagttctataacaaatttctttgcacgttcaattttgaaaattgaagataataactttatttgggctctcaaaataaaaaaattccacacaacattatttgataaaattgactttaaggaaaagcaaaaaggagggtttttctcactttattgatttaaagtcctttcacattcttatttttgatgatcacaagtttagttttcacatattgatcaatgtaagtttcatataattcagaattgtctttttgagaggtattttgacatttcttttgagatttcaccatcatttcacaggaatatccatggcggacagtggcagatccataattttgtgcaaacaggtttaattttagaagtacataactttagtcgtaaaataataattgtcaagtgagttcaaataaaatatttatacaaaatttacgcagctttaatcgtaattcatacatatacacattattattttttggtgaagccggttcagttgaatccgcttcaccacgtgcaccgccactgatggcggaccatttaggaaatggcacaatctcccttggcttcctaagatggggaattagtacaacccttcttcaacaaattcttgagcggaaggtatatcgaaaacagtctttctactttcacaagataaggataagatctgcgtatatattactctctctagatcccgcactataaacgtacactgattatgttattattgttattgtttggtttgggggagggggcgggaggggaggggggggggtgagtaataattagatgcaatactttgatctcgtgtgtatataaatagtccaaccagttcgaatctacgccataacaaaccaaagaggaatctttactattccaccatataaattaatataatactccaacttcatgtatggttttaaattattattcttttttgtttaacgatcattgaatgtcatgtatacactaatcgattaattcgaattcacgtcataaaaaattacagaaatttttatcgtttttcactaaggatgattctattccaatagtcgaacaataagacctctggttaaagtatatggatttctatcgttccttgacgagcttgatctcgttggtggatatatttgaagccatttcgacatcaaaggggagtattcttgagatattctttaagtaatataacaatttttagcaaacttttcaaactgtatactcgttgattttcaaagggggtattttttctttgttatttaacaaaaatctgtttttattgaatacaaatgtggggtatttttctttttacatttatatattaaaggtaatagaggaaacaagaaattaaagaaggaaaattataatgccgataggcagaaaattaggttttctggtcatgaaaattaccatgctgaattttaaaacaacaaaatacagctaattagcttgtgcaaatatttaaatgttacctaacgtatgtcttcactaaaagagcaatacttagagcccgtttgggcataaaaaaaaatttcattttttttttcgaaatcagtgtttggtcataaaatttgcaattttcatttgaaaatgaatttttaaaatttttcaaaaattttgaaaaactccaaaaagccgtttttctaaattttcactcatatcactcacaaacttcaaaaaaacccaaaattatattaatatccaaacacaactctaatttttaaataccattttcactataaattttttcttttacttttttttttagaattttacatttcttatgtccaaacacccacttagatgtcttcattaaaagggaaatacttagagtatgttaaaaagtgtcaaaaaataaataaaaaaacccattagaccatctgaataaacaaacaaaatagtttgataaagaatatcaagttaagataaggcgttaattactgataattgttttttttttttgcatatttagtaaaaaaaatcgacgaagctatgttgcttaagaaaagatttgtaggaaatctcaactaccaaaatttaggtaatatcataatatgagtaagttttaagaatattaacatcaaagtataccaatttatttatgaccatatagtattgtcattttcgtttcgacttctttttccatttttttagtattccaaatataaagcaaaagaatttcaagttcttcaaactttttctaaataaatgttactatcaaccttttatcatataggaaatgtcttatcaatattccctctcaaagtttaacaattttagtaagccagaatacttacaaaggcagataggaaaaatattattaaaatttttttctaaaaactttacattataagaagtttctttcctcaataaggagttgtaacaagtgatttggtctgccaagaataagctcttaaggcaagaaatttttgttgttatgaaatatatataggatattttccctctagaccaagttatgtataaatgtggagatatatttttccctctagaccattttaatataacatcaccatttatatgatggcatataagtgtgtaatgactactcaatgtacgtatttatgttgctttgaaaattgagttcattccgttgttcattttcatttgaattgtcaccattacaagacattacatgttgcatctacctcatatataggagttgcaatgcgcgggtggggttgatatggttcgggccgaaaacggataatgaaaaaacggataaattattcgatccgacccatgcttctatacggataaaaatggattaaccggcggataatatgggtaaatatattatccatgccttcttgcatatgatcacttttagagaattcttagtctctctaacttgaggaaccctcaatttgaggctttacaaatgtaaagttagactcattggtttatccattggttatacctattggttgtccattttctaaatggataatttggttcttgttgatacccaatttttccctataatatttttaaaatgcatataccttcaaataatacattagcattaactaatatttttccacaatttctgcattttttaggattttaattaattatttcaggtattatataaataattactattgcattataataatcttatagcaatttttatgacttaatttcactatttatattcatactaagctttaattattttataaatagccacatttatattttgtgttataattgcaataactttgcaatatacctatgtatgcattatacatattttaccagaaataactttttatattttataatattaagtaattattttaaatcatttttatgcatgaaaattattttataattcattaattattttataaattattttattaattaattaggtatttaacaaatagcccctttaaattcattttaatttcggacctaacctgattcactagcccaattacttaaaatcctaccctttgcccaataaaaataccaagccaattcttcttctaacccgccccaaccctaactaatcatggccgttgatctcaagagatcaacggtctaggatataatttctattttaattaggcaacccccaaaacccttcctcacttttcatttctgccgtcttcgttctctctacctctcccttttctctcaaacactctccctaaaaatgtcgctgtcacttgaaactccccgtctatggggtttctgtgtattttctggcccttgccagccttctacatcttctggttgtttgattacatggatttctaagagaatctcaaagagattcaacttgattttgttcgaaaccttcttacaggcctgtctatggctattttcgtttgtgagtattattttcttcctatttatggctcgaatctatggttttaaaccaggtttcttccatctctgtcattttcttgaaacctaatctatgctacttgggtctgttcagatctttgtagatttgaaacgtttttaagtgtattggtatttctatttgaaaaatcttctgtttttcccttattactaatctttttactggggtctgttcagatccttgtagatctgaaacgttttaagtgttatttggtatttctctttgaaaaaccttctatttttccttattactaatcgattctaatattttttgaaattagggtttcgttttaagccctctccaaaaaggttttaaaactcctaagtatttgaatatgattatctttactagtttgaccaatttttgtatatatgctttaaccctagggttttctgcttattgcattgattacttcaatttttcttccgttattgtttatctctgtcaatcaaagcagattgattgattttatttagggttcgaattatattttcctgttagaattagtgcttctctgtgattttactgattttccttatttatgacctttaattagtaccacttgccttatttagattaattagtctgatttatgatctgtgattgacttatttgccttatttgaaccccaatatggacttctaattgattctccctattctgaagggtctgttccatatttttctatgtaaattgattgagttaattccccaatcaactggttgatttatttgattacccagttttatgaactctgaattattcttgtcttttttgtctactttactaagttctatattacactctcattactgattctttgagactcaaacaacagttcacaagcatactcacatactttgctctcatctctctgctacttgtgttgaccatactgtctagccggctgaaagccaaggctagaccactgaatcctgcatactttcacttcttgtttgtttcctttaactggtatgtttctattcctaatgtcacttattatactatgaagcttgaacctatgtgctctttcatacgttatttcacccctgttgaatccatgcctcttctgtattttaattagcctgtctatactgtgtttaaatctgtctctctcctgtttatcaccttaatctgcatgtttacttctgtttaagcttcaatctctcatgtttattgctttaaaccaacatgtttacttctgtttaagtctcaatctttcctgtttatggctttaaacctgcatgttcactcctgtgtctaagactcctatttttcctgtctagttgacttcaattggtataaccaattatgtgtagttaaatccttgtcctctctatgacttgattagcatggctactcctgcttacacctctatattttcctgtctattgcttctagttagtataactacttttagcattaagtatggccgctagacttatgtaattcctgtctagaccctaatcagtatgtcctggtgaatgttataaatttcaatctaccccttcctgctctatctccttgttaactagcatgctctccttccacactgtttctatgtgctcctgattcaggattcctatgttcccaacccctgctcccctctctgtgtaattgattctcagcatgctacatgctcacctagggttaactaataaactaagtcgaatctgggtaatgtgagtctttgctttgagactttgtgactatgttctgtttgttgttggtttactgaacctttgttttcagaatgtttctaagctgtttcacttctaggatgttttcacttttaaactgttttcacctctgaattgttttcaattctgatctgtttcacctctgaactattttcttaaaactatttctactctttcaatcaccatcttccattctactcttagaatatttaggatcctacctctccagtgtgagtgctgtctaggagtccattgagactcctccgaactctgaacactggggttggcccttccacactgcacaaaactgtttctctttaaaaaaaagtcttggtgtgagcatttcccgaggttcctgaggcccttgggaactttgatgcaccgggatactctcttggacactatgagatattggtacttcatacttgattgaaggcctggttttccaggtttactttgggcctatccaggctccctataatataacattatttattctgtaattcatttatcttatggtctataatgaataattcttgtaaacagatattggggatattagtaaaatgggagggactttttatatatatttgtggggaaatcgggtagaaatcatgctcttaggactattatgattatctatctgcattaaaaatcatgcttataggattgttctgtgcactacaaaacatgtttataggtgcatcatataatttgttctaaacttttgctttctataggtgcatcatataatttgttctaaacttttgctttctaaatttctgcatactcatgtctgcttagaaatcctgtcactaggttgttattaattatgcctaataatcatgttcataaaattcttctatgtgcattagaaaccatgctttagaacttttattgcattcgtctaaataatatgcctacatctagatcgtataaaatcagtttcttcaatagcaactatgtctataagaataagtttaaaagcagtcccaacacctagatatcatccttatagagaaaatacataaaaatcagttctgtaatgtttgtgattattttttcagcacctagacagcatgcctataggacataatgaaccaaactgcctgcttaaaatcatttatcggtttattatgactccgattaacaattagatatcatgtttataggacatctcagatccacacctaggcaagcctgtaggataactaaaaaaaattacaaattgtaaaattgtgcttctttaattatttgtgaactgcccaggttcagcaagccctagaatcagtaggcaaactgattaagtccctactgcctcactttaataaatactgcatatatcctgctttgtgctcacctagatatcctgctttaggaccttttaaaatgtctgaaatactgttgtttgagatgtgcaattgtctatttatttgtggaggtaaatatgagtctttaactgctctggtatatgacagtcctatttattttgtttgtcacttagattttctccttttaagcaccgtaggtgagtctagaaccaccttaattagaagtcctaaacacctccaggaccacaggtatgggacgggtaatacatgcatagagtacgtatttaattagaatcgcttatacaaccattaagggagggtaattgggcagtaaaggatatgataacctgtgcgctaataccacgcgtaacgcctctaattgaggaaagcttatcgggtattgcacagaagtgatcttataggctaataaacctaggacccctttattcccactttatccttacgtgtttaaattgtttatttattcaatgaataattcacaaaatgagtttggcagagacccaccattgtggacctcgagggtgcctaacaccttcccctcaaggtaatttcgagcttttacccaaatctctggtaatgtaaaccggtttttatgagttatttgcattaggtgccgtaacacactttaatcagttaggtggagactcttcaaattccatacccccttcctaaaaaaggaaataagttatcctaaagaatgtctaaacccggattccgcggaggaaaaagggggctcgacagttcttattcatatttgacccatttttaaaaagttcattatccaacccattttttagtggataatatgggtggttaactgttttcttttaaccatttttccacccctactaatatatcgggcggactaatcctatacgaaacaacccaactaggtgagaatcgagtgatactatgatatgttgcgtcgcaaatgcatacttatctgagtaagtacgttgcttaataagggacgaaacacatttatatcagttgaataacattcatctaaaaattataccatttatatataggtcaatgtgccgcccttgactgggacaagttgacgatagcggtcaaagagaaggacaacatgttttaaggttaataagcttccgaagaaagggtgcatatatgattcttcggccaaatctaacattgaaatatataagacatagcgcaagcacatagtgtagcctagagacaaattcgtgatgcgtgttgggtcaaagggacaatacgtgtcatgcgctggcatgtgataaatatagtattagagcttagcttgattcccgcagtacaatagtggggcaagcctcgacgaggatgttgaatcactaaaagggtgtatatgatgcctttgattttgatggaggacaggttgaagaaaaggattaatagatgttagtatctgtattcgaaaatgtaatttctgcaaaataaaaggaaaccagaaaccaaagacagaaatagaatgaaatgaaaacgttccgagcctaacagaaattgtgttttcttaaagaatttaatcccgccactgttgcccaaggttgttggattaattcctcctaggatagaacgaaacaactattttgtaataccggtaatgtaaattatagaacttcgtcgaactcaacaaacgacagtaaaccacactgatgcttacgttttgcttttgaaaaacaaatgcagagagagagaggagagagtatgcaaatttcggtggtcagaaagtgagaccaaacctttgaatttatagccaaacaatctgggttgaataggtgcgaaagtacttgttcacatgaggtactgtttcggcagaaaaacttttctgtttgatcgcgaataacgaccaagtcaaagccgagcgatgacgaggtcggcgcaaggcactattcttctgaattctttaagagctagaagatgtgtttctctatagcacacagattttctttccttctttagatgagggacaaagtgcattagtaaaagaaactatttcaaattttcttttcctccttgatggattgaaatatcccaagaataatttagccacaagcaaaacttcaacaagactatatagaagaaatttattaggctaggagaaaacgtggtaggaggctttttcacaactcataaactcttgaattctctacatcatagctacctctccacaatagaaaatatgtaataacacccctatttataatactacaaaaataaaattgactagtctaacaaaacttgttccaatatgaacttagtaaataaagcctaactacacatgaattaagtaaactagtaaataccaaatcctagacaattaggaatactaattaatcttggtttaatttccaacagcctcccttaaaaactaacattttcaaacttgagcatgtcatcaagccttgtagaaatcaagtacctcagactctccaccgattccctaaaatatgttgcatcaataaagttacgagtattatctttagttaacttcaatttctcttcaatattggccatatatgatttggctttaaccatggtaaatcacttcaaatatcatcaacatattttttctttaatttaaaaccatctacttctccaactgctttgtgggtagtcttgtatacccaatcaactccaattaagtattctccagagtgtggagtaatgcaccaataaacatttcgtcatgcttcttagaacatgcaatctcaaactatggaacaaaatttattgcatcttcaatatctattgtcatgccttgttgtggttctggatcccaagctatttttgcctcaaacttgggtggatcgttagaaactttctcttgatgacccatcttgcttctttcattactcggttcatcttcaataccatcaaataattttttttttgtgaaataccaacctcggctggcaacccttgcaactaaatcatcctttttaccaatcacatgaacttttgaaaatcaatttgaatatttatttgactttcctttacattcaatataatctctatcacaacaaaaattacatgtaccttctcttttttctcgaatgttttgaattttggccttcttgatttatttctgccggatttgatgtgtcttcttttccttttggttgatcaaacttttcttgcgatgcatcctccattgtctcatctttttgttgattgattaacattgcgtatgtcaccaataccttttaaatcatcaagtctgcgagtgctaagatctttagtagactcaagaataacttttttgttgttaaaatttaaactgagagattgcaatattttctcaacaattttaacttattgcaatacttctccattggtccttagatcattgactatttcagtaattcttgcaatgaattctttaacagactctgttggtttcatatgagccaactcaaattgactcataaactcttgttttctcctatttcacgtcagcaacttttcgatttgacttcaccaagattattcaagcctcctttgatgactttgcatgcaaatttttttatatacatacaagtcgaccttaatggcgagatagtagcgtgccttataatctaattgtcttttcttctccaattgcgtagctgcattacctatcaacgttgtgccttctggagtatcctcaaatccttcatcaatggtggaccataatccaatagccttaaaaagattcttcatctattgataccaagtttcaaaattattttgccatcaaacacaaaaatggaacaattaggtaatagagtatccatattttttatttttggatctcctactggttctgacagaatctcacacaggctctgataccaatttgaaggattaaaatatcccaagaataatttagacacaagcaaaacttcaacaaagactatatagaagaaatttattagactagggagagaacgtgataggaggcttttcacaattcataaactcttgaatctatgtacatcatatctacctctccacaatagaaaacatgtagtaacacccttatttataatactacaaaatctatttcaattagaaacaggaaagcctatttctgtatttattctaactgcaaatcatatttagacatgaattaatcttggtttaacttccaacattctccgtaattcaaagttgtatacgtctgacttgttcgttgtgcagttatgttggaacacttctctccaacttccacttttgatgaagcacatgtttttcatccctcgttgatgcactttgttaccaacacccaattttgttgaagcacctgtctccaactgtttgatgcattttgtcatcagcacccgatttgttgaagcgcctgtctccaaaacccaatttgttgaagcgcctgtttccaactgtgtcacgaacccaattttgttgaaacacctgtctccaactcatgttgatgcactttgcaatctctcagtttaaagtttaacaacaaaaaagttattcttgatactactaaagatcttagcactctcagacttgatgatttaaaaagtgaattagtgacatacaaaatgtcaatgaatcaacaaaaatatgagacgatggaggatgcattgcaagaaaaggttgatcaaccaaagaaaaagaagacacatcaaatccgaaaataaaaacaacaaactaaaagaacataaacctcaaaatataaacaaacaaacaaacaaatacctttcatgcatcacttaatactcgatcacattcaaaaacaaattaaacttgcatgatggccgccaactgctccttaagggcttgcagacgctcttcaagcatcactcattttggagacagaacaggtagagtgaaatgcttatcatcccctattagaccactgcacacatgcaaaaatacattcctttcaatctcatcaaccaacttgtagatagttgatgtcatatagaacatataaaatcaaccaatctcaatgaaacaacttcccaataaataccaacttctatgtaaacttggaaggctttctgaacaatatcactgttatattgtattaaatgattaatgttgacttcctggcctatatttttaagcatcattttgtgggcaccttttgatagatcctcttaaaaaatgaaaaaaaaatctttatctgttgataccaagtttcaaaattacttttatcattaaacacaaaaaaggaacaattaggtaatagagtgttcagatcttttattttttagatctcctaccggctctgacaaatctcacacaggcctctgataccaatttgaaggattgtaatatcccaagaataatttaggcacaagcaaaaatttcaagaaagactatatataagaaatttattggactagggaaagaatgaggtatgagactttttcacaactcataaactcttgaatctctacatcatagctacctctccacaatagaaaatatgtagtaacacccctatttataatactacaaaaccaaaattgactagactaacaaaatttattccaatatgaacttagtaaataaaacctaactagacatgaattaagtaaattagtaaataccaaatcctagacaacttaggaatactaattaatcttggtttaatttccaacactcctactcttttccttctattttccattcacacctcttatctaattagatagaaaatccaacaatagatttctaagttgataagcttccgaagaaggaatcgttgacaagtctcaatctcatattggaaagagagagaaagtgaagtgttatataatgtaaagcacaagttcacatggtatacgtattttttgggctcgatgatggcatagccaagaaataaatccataagacctgttagaccaaagcgaacaatatgtgtcatggttgaatacatgacagtaaaatattacttttatacctatatattaaatttaaaacattttaaacaaaattcttaatttcgccacttgattcggtctcgaccctctaattgggtcgtgtcatattagctcaatgataaaaccaaccaaacacaattagagtcatttttctcatttattgactaatacggtcagacctctctataacaacatccatatataacaacacttcattataaaagtcaagtttttccggaactaattcttatgttatgttataatatatgttttctataacaacacttcactataatatttaaaaatattctgaatgaatgatgatgttatagagaggtttgactgtagtaataaaaaaagagacagcctttttcgactagtaaattctaattgagcttaggtaagtcgttaatctgccaatatctcaaatttcacctaatcctgcggaaaaaaacatctcaataatgaacccaataattagattaccagcttttctttgatatagacacatgaaaaatacataattaatataaagaaaaaaaattatttcttatggaccgacatgtagaataaatagcacaataatatccagcctcatggtagtataatcttagtcattaaatagcttttcttttttcgttaaaaaatgttcctaccattctttgctcttgtcgggagaaaataatataaagccatgggcatacaagaaagaatgataagaaaaagaaagtataacaaccaattatcgagccagaaaagtcctatatccggggatggagctacagtgatgggagcgggtttgacccaccttagtaactttagttcgaactttgtatttgtcattcaaaaaattcattgaatattggggtaaaccgttatctcttcatacctgtttaccctcaaaatcggataacaattgaatttgtacgtgtttttaagaatacgtgatctaacttatacaaaatgagaaatcggattaaaattgaaataaacaatgagaaagtaaatgcaaaccacacaagttgaacaatcttagccttggaaggttagctactctcgagccaaaaatgcctttatcgatgctggacagaatgaccagataataagaactagaaataataatatattgctttggaattcgttttacaatgtgttgaataaattatcagaccccctttaatagtagaggagtcatactttaggtacatttctataaaaggtaaagatctcttaatttgctgattgtctgttccttgttgatacgtgccgagaggcccgccataatattcgaccgatcgcggatatttcgatcttctgatagttatctgaacaatgtttctccgagcttgttcgaggctaagatcgacaacggacttaatgttcctcgaaggcaggctttccgacctcgtattgtagctcagtgggactcgaggttgatcttcagtctttgctcgccacgttccaagcctaatctatcaagttgtagtcgagctcgacttcgaccgtaggctcgaacacgagatatttagttaaaagttaacaagtaattatcacttcatcacaatccttactggacaaatataactagttagcaacaggtgtaaatgaaccaactattttcaactcgaattattaaattatataattaaatacttattaaaattatatattgatattaaataattatcatttaacatgactgagtaatgaatataatttacttcacactcatgagtaatgaatataattttcttcaactccgtttctttttgccccatgaaattattatcgataaaagattattggtctttctttttttcttcatcccaaattttaattacgtgggacccatttaattatctaatggttctggttgattgagaatgagcatattttgtatggtatatagaattataatgacccaatttaattggatgcacgtgacaaaatctttcgtctcaatattaaacagctattgcaagttattaatattatttttttctttttccttttggcaattctaaaaagtagaaggaaattgtcaaaaaccagaataataaagaaattattattattattaaattattattattattattattattatactaacctaaaacttttaaaactcatgagagtttgttttcagcaatttcaataatagtaatttttgcccaaagctgtcataaaaataggaaatctaaaaatgtacaacaatacaaagcatagagagcaaaaccatatccatagcatttaatgctccagccaacaacaacctatggacttgtgtcatttagtgtgccattggagagggtgtcgctaaaattattaaaataaatcaatttataatttttttttttgttttttggttaaaaatttataaaatataacacaaagatatttgcaacttctaggccagttttgttaatctccagtaaaagcattaaaagcactggagaagttactacttcccaatatgctttcaacacaattaatataatcaataaataaatactaaaaacagtactaaaagaaattaattaaaaccctttgatttagccttggttttgggaaaactttcattaagaataaatatttatccacacgtatttatatcaacaacaacaacaaaaacaactaacataccctatatattcccaacagatagtgtttgaggagagtggtctgtacgcaaagataaagaggttgtttccaacagaccctcggttcaaaaagaagaagaaggaaagcaagaaagaaagagagaagaaaaagagggagatgaaggacacgtattgatatcaaattaagcaaaataaattttaacggttaaaaattaaagtaaaattatatatcagtaactcgttaaacgataaatgcataatattttatatttgttgatttgatataaacatcgaatctgagtaaatttttatcgggacggagacggagacggggacgggaacgggaacgagagagggagatgggagatggatactattcatatatttgatggaccatgtcatgtgaaggaagacataataaaatccaagatgccagacaaagttgttgaaagattagaaaggaatatttgggagtatgaaagggaattagaaggtaatgtgtgtgtttttatttaggtttatgcacatgttacctatttatgcttactaccaaacaaatacccctttatatctcaagtcaatgcctctcttctacttttatcttcatacatatgtattcgtgtacgtatattataagcagtgacggatctagaattttaaagtcgtgggtgtttactggtaaaaattctgaaaaaagagaataaaggagttatttatgggtgcttactcgatatttatctgaatatctttgtaattacctatacaaatttactaaatcttgtcaaaaataatgggtgctcgagtacccaaaaataacatgtagatccgccactgattataattattttacttacatcactattaagaaaactgaaattagctacgaactttgtcacttgtctgtcgccaaatagcttgtagataataaatttttttggtaatatgtcgctaaaccgtcactaaaaaagattaatggagaattttttttgtttaattattgaatttgtccatcgctaattcttattttttagtagtgtatatattgataatatattttttacactttttatgtaatttaatttggtagaacaattaccatttttatcaagttgtctgttgatcttattatagagatgacatgtaattataagagatttgattgtataaatattttttatattatcgtaaataaaacatataccttatgataagggtataaataagtacatatgtgatcacaaccccaccaccccaccaccccacctccacttagtttcaagaatccattgttggggttggggtgtgttaaagaatactacaaaaatctacgtagaagctgtagatgacatattatcttgaatacgtttgtctgtccatgttgaaataaattaaaaaagggcagtccggtgtcttaaactcccattatgctcggggttcggggaagggccggatcgcaaggatctattgtacgcaaccttaccctatatttgttcaagaggctgttttcacagttcgaacccgtgacctcgtggtcacatggcagcaactttatcagttacgccaaggctcccttcaatgttggtataaattggtatttctaattaatttagtaatcagaaaaataattagagtaagataaagtgtataaaaataaataaataaatatatatatatatatataaaggagaaaaagatactaataagaaacagagaaatctgagagagagaatgaaaacagaaaagacaagaagtagaagcggagagagtgggggaaaaagaatcacagagtagagttatctgcgggaaagaaaattgatcaaaaagtgactatttatcttttttggggttcaaaaaaacaattaatttttatattaattaaataaattttaaattatttccttaaaaatcaactatatgcaaatgtttacagtattatatatttctttctagatttaacttttgtaggtaaaagaaattttatactatatttaagaaagtagctcggtgcacgaagtatcccgcattcacgtagagttccagaaaaacctacatcctaagagaagtgacgtatacagtccctctgatacaatcatcagttcctgattctatggttcgaactcctaatgtataaattacatagagacaaattttacaatgcgtgtaactgcatataacatgttatcctctacttttcaagtttttaacacgaaatattaactattgttgtatgtaaaatttatgtgatgataaaaaaaattgtacaagttaattacatgtaattgactatggtaaacttcattcataatttgttgaagaagataattagcaacttattctatcttttattagaaaataaggtctttataatatcagtttatatttgtttacactcatttttttcatttatttttctctttatatatctatatatatacatatcttatatttgttcatacttgtctatatttttattaatgtgatgtttatgctttactaagccgagaatttattgaaaacaacctttctatactcacaaggtagggataaggtctgcgtacacattatcttccccagaccccacggtgcggataatactgggtatgtagttgttgttgttgtatatcatatattccctccgtttcagtttatgtgaacctatttccttttttgttcgtcttataaaaaatgatcctttctaaatttggaaagaatttagcttaaacttccaattatatccttaatgagatgcttttataaccacacaaatactctgaccccctttttgacttgtttagcaccataaatttcaaaagtcttcaatatttcttaaacttcatgctcagtcaaacaaattcacgtaaattggaacggagggagtattttaaaaataaaataaaataaatttctgaaatttatgtacttttgtattttcttttgatgctttgcttgttttgactagagagatagagagagagaagaaaatagcctctccttgttctagtgtcattttccaagatatactctcgaggaattaacaccttcttctcttcctttccattcctttttcctttttctttcttttcatttatttctttaaaatttcttcatatcttcttcttcttcttctatttcttcttgttgttctctccttctgcatatatttttactattaaaagaagataaaagagtttcttttctcactttttctttctaaatctattagcaaaatcaaacttgaagtttgtccatctttttctttttccccttttttctacatctctttgtgtgtgtgtgtcttgtttgtgtttttgtgcaacttttactctattctccagggcatatcgttataaatttttgggttttttggagctaacaaagaaaaaaggaaaagctaaagtcttccccccaaagtaaaaaagtcattataagaaaattaaagaaaaattcttgaaattttctttttttttggttagattttctttagtagttttaatccataaaagatgccattagaaggggtttccattgaaccccaatcaactaattcaaagccaattcctgatctttctctcaacattagcctccaaatagttcatcttctccatcttgtaacaacatcaatgaattgctagcaacttctagtttcgatctctcgagtcgttgttgtaccaatgaagtgagtgaaaatcatagaagattagagttcggtaaagcaggaaattgcccttactgaactctcgttagctcatccaaccaccaccacaaccacacaccacaaccggcaccatcaatgatgaaacaagaaggggtttttagacttaccaagaaacccttattacaacaaccaccatagtcaaaattataaccatatggtgcaaccaatgaatcaaataaatcatggggtttcttctttagatgtatcggacggtttaagacctatcaaaggtattccagtgtataatcacaaccgttcatttcctttcttggctaatttagacaaagagaaagatccaaagatgtgtttttacccaatggcttcatcatcttcaccacttttttctcctacatcttcttctccttatattaatactaggtttaatgggatttcatcttcgtatcaagtgccacatcatcacctacatcatagtcaatatggtgtaggattagggcattcttctcatgaaactgcaacttctcatcatagtttgatgagatcaagatttttaccaaaacttccagctaaaagaagtatgagagcaccaagaatgagatggactagtactcttcatgcccggtttgttcatgctgtggagcttcttggtggccatgaaagtatgatttctgtagcttattttatgttatcggagacggatccagaatttaatctgaatgttttcaaacctttgatatttttagcctgaacacattgtacatcagttcaaacttattatcgatgtttcgttctaaaatattgatttttgtgattgtcacggattctattgtatgttttcgtattcttgagttgatggtttctcggaaataacttctctatccctccatggcaggggtaagctcagcgtacgtatatcgagtgggtggttgtagttgtagttgttgtttcgttctaaaatatcgagttcagttgaacctgcgtatcctctgtatgttataatttcaatatttttgaggtgggaaatgatgaaaaaagtctaatcttggatttttgtttttgtgttcttgatttttaggggcaacaccaaagtcagtattggagctaatggatgtgaaagatcttactctagctcatgtcaaaagccatttacaggtacttagaaattaaaaaaaaattagaatattaaatagaacaagaagaatctgttttttattttttaatatatttttttcttcttctcttttttctctctgtcaaaggtccctagctcaggatgaattcctccggcacattagccgataaaaatacagtgattgactgagtgaatgaattaaagaaacaagtcttatctttctgatagtatcagagagaaagaaaaaaaaacaaagtgagaaaaatatatacttaggtaaatatactagtcctactatagtaagaataatagggttgttggggggtggggttgaggggggtgagggggtacttggggttctgttacagacaaaagtaagtcatcattattcaataattcacctcgtgattaatgaatcaattccaagaaagaagcatttgactctgaaaaatttttccctccctagaaactctaccactttattttttgtgtgttttttctttttttgttttttttctttgtttcaacgtcatttcacgagagataagtgtaatgtgtagtacttgtacttatttttttgaatttcttgaaatatgattttttttctaatatttggaaaaaaaaaattcctttcccaatgcagatgtatcgcactgttaaaactactgacaaacctgcagcttcctctggtaaattgtcttgctttaagtcttctgcttacttacttttcttcctatttatattttcttcctaataatcagtgttattaaactcattttgcaccataagatgacatttacaatgtggtgattttcttctatttcgtttacatgcaatatatacttgcatttaacaatgttttatacgacgataggcgtaaaggtttgactaattttacacaaagacggatccaggatttaaagcaatgcggcacagttttttgctcaaccaatgcatgcccttaaagacttttagtgtttctggtgctaagtgatttaaattaacaattttttaggtataatatagcgatatatattatatatatatatatataacatgaagtgtctctgtcattttcacttcttattactcctttcgttcactttttttaatatatctagtaccagctaattcattcggacgagacatcttacgatgtcatgatgcgcccattccttttatacttctggctcttaggagtctctgtgtaggatacttggccatagtgtgacctgttagcccataaataagtacgatgacccctcaatattaaacatagatccgcctctaatgatctccttatactgaccatggttcgaagacctccagctggatctgaaatggatcaggtagggcatccgtttacaacatgggtgggattagcagttttctctattttcttcaatggtaggaaatacgcatcaagagggtatatgagaggaaaccagttctgtagtaattcaaattgcttcttcagatcactaagtaaaatcttgactcgtatatttttttcgttgtaccgaaatagagatgtaatataaacgactatgtatagcatatttatgagctcgatccatgggagttcaactatacaatatgttctttttttagaaaagaaatgatacacaagacaataacatctttgattaatgtagataatttttacacgtatattttaacctattatagcaggtaatctacattaattttcttgtgactaatcatatattttaaaacaattacttatagttatcttttagatgatacgatagtatttaaattctttttaaaactgcgagtgcataaaagttaaattctatatatatataagttttttatttttgatatttttaatttgttattatcttttagggcaatcagatgggtcaggagaagatgatctcacaacaataggaagcaccggcgccggtgaccggactagtttatgccggtttacggatcagagaggagcatctgatggatctttacaacccgaatccgattacccgtctactgccaatcctactctttggagtaattcctcaaggtaccacatatatatatactacttaaaattttagtgaacgtctactcacatttcaaggaacttttgaactattaaaatacttaaaaataattataagtaatagttcatagaaaaattagataagtaacccgaaaaaaaataaattacctgcaacaaatagtggatcgatatgtcatagcgttggtttgaattgaatcccattagttgaaaagatctatactactactacagtggcggacccagtattttatgcatatggattcaatcgtagaagtacataactttaatcgtaaaatagtagatgtcaagtggttcaaataaaatttttatacaaaatttacattgctttaatcgtaatttatacatatatacaatattattatttggctaagcggattcagctgaacccgttttagctctacgtgagtccgccactgactactatggtacaaatatattcttataatatttaataattatatatatatatatatatataaattgaatacttttggggaagcttttaatctaatggtaaaggtggttcgaaagttgcttcggggcatagagtgtgaccatttttaatatattttttgaatctgctactgtgtgaaacaatgtgttaaaataccctgacgtataggagagatttgttttaacaagtaaattaaagttatctcgtgtgatgagtggcgaagccatatggtcacaagggtgaccaccctttgtcgaaaactgcacaatgtatataggtaaaaattacgttttagaggtatataacacatattgaatattctttatcgaaaattttcttttacttcttttaatttgaatatctttgaaaaaattcctaacttcgccactgcacgtgaacaaagtcgcgggttcgagccatgaaaaagccaataatacttgcataggatatgctgcctacatcacaccctttgaggtgttacccttccttaaaccaacgtgaatgcaggatacttatacaacgactggcgtcttttagtagaattaaaaaaccatggttcacaagtagtagtgtagaacttttgaagtaatgatggaggaatgagttgcatactttttcttttgcatggagaagttaccctgaattttagaaatgcaaaacccacgtccaccattttctgaagaataaaagatttcttgtggcagcttttgcttttcttctttttcatttttccactttctactttcaactcctttattcccattttaattacatcttgtcgtactattttctaacctctattttaaatttttttcatgcattcttttctttctttttttcctttttcttaaattaaaaagacataaaaaagcgaataatatcgtaagagttgtgatagaatggataggatttctttactttgggagaaattcaaaaatagccagatttacaagtggtcattcaaaaataaccataattttaaaagtaatcgaaatttaatcacttttcttgtaaagataaatctgaacgaaaacacggttcaaactccgaaaaatactccagcataatatactggagttccagcataagtatagtggaacttcagtatattatactagaccggtctctgttgcagcaaaatagtggctatatttcaatgacttggcaaacgatgactattttgaatgatcattacgaaaactgactagcccgtgctatttttactaaccaaaaatctcgatttcgaacctagaatggaaaaaatcttagtatgaagcactttcctatttgataggctttacaaaacgtgaatttagattagtcggtgcctcaattcaaacctcagacttggtgaagaaagaagaaagaaaaccgtactcatagggtaattaattaggattatgataagaaagcaaaaagattactgctatacttttgctttcttttcttttcttttattcttttactttggttgttttcttgaattattttattaaagatataataaacttttcttttcttccctttttttgttgctttgttgttatttcttcacgaggagattttgacaaataagtccaaaaaaagaccagtatcttgacttaagtgctctacttttctcaagtaatatttatttaatgtatccatggcttgtttggtcgtgtgtttgtcttttttaattatttaattttttcgtctatttaaagtagaaaaaaacaatcagatcttgttatgatccagttactatatatgtattaggattgcctgcttctataatttgtcttttccttaattaaattattcgttcctattatccaaatatataatcaactctaagacatataaaagggagaaattcaaaaatagtcagatttataaaggtcattcaaaaaatagtcataatttataaagtaatcgaaatttaatcacttttcatgtaaagataaatatgaacgaaaaattgttcaaaatccaaaaaatactccaatataatatactggaattctagtataatatactgaactttcagtataatataccggtccaacataatatgctggaagtacatacacaggtgctccaatctctgatatattaagctggaacttttcacgtgttggagttccgcataataagctgaagttcatacacaggtgcaccgatctccagtatattatgctggaactttccgtgttgcagaaaaatagtagctatttttcagtgactttacaaaggtgactatcaaaaactggctagctcgtactatttctactatataaatcacctcaaaataaacatagaatgccgaatctgcaggtcatcagcagatgatttttgtactttttttactctagtagttggaagaaaaacttttatttgtcctattgtacgttgaaaattttactttgaccgttccacattatttattttataaaataacagttgaattaaatgacaagtactgtaattcaaatgtttgcacatttttggataaaagaaaacataaatttaatatattttcaggctaataaagtattttagtataattatgtttagctatagctccttaataggaattagtgacataatactacttccttagtctcaaattagtttcattattaagggtcaattgagctaatttttattgatttgcataatattgtgattaattaaattagtgtcttatattgacttgaataaatgatcagttgttgtctctttatatagtttttttttggaatgattttcacctcgtgcactaaagtttggagtcgagatagacccaagattcatctttttaagatggtaccaaagccttatctatccttgttattgtgtttcccgttgcgggtctgttgttatgttatttacgctccagctgtcaaagcattggcgtgcaagagaagggagatgttagatttttccacattgattgagtaaacgagatattttcgttatataattttgcgcttttgggttgagttacactcgatatctgtattttttttacgagcaacgatagtgaaattcaactgaattgaagtatacatttattttttttcattttaattatatggatagtgaaattgtgatgacttaatttttaccacaagatagactgaaaaaaacataattttttactcgaaattttacagcagtagagaaggatggttgcaagcaaattccattgatgcaaatggccttagatcaccttgctttccatctaaacaaagatcaggtcaccaaattgaggtatttctcatacttttttattttaatttcataatcttttatgtacaagaattaaatcattaataggctgatcgaaaatttgaagcttataaattcctacaacgacttagagataatatataatattatataattggattcacggtcatagatttatatatttttagtcaattttttatttaatttctattatatttgtctttttttaattactatattgaaaacactatgattaaatgaactaaatgtattaattttgataatcagaaaaatccaagcttggagttcacattaggaagaccagattgggttgaaaaggagcatgattgaagataaacacgttcgaattaaagcatgggcatctgctattaaaagggagcagtaaatcgtcgatcgtattaatcatcacttcaatttgatcttgatttagctgattattgttttgactcttttccttttctttaattttggaatggaagagaaagcttgagcatgaaaatattaagagctacataaaaaaaaagaaaaaaaaaaagaaaaagaaaagagaggagatgtatgacctaaggttatatagctaattaaatatccatgcagatgacctatagagttggatgattttttttttttttttaaaggtttcccgtccatattttaacctaccccgcctttttttccatgcccgagatggttttatgagtagcagcctcccatatagatggctttgtggtcgacttctattctgcttgttcgaaagttctttcggatctctttccaggtcaatccatttatcaatatctgatagtggttgacctatatggtatttatacctctttaattttttattttggttttgttaatcttttttttttttaatatattgggttggttgatatctagccattggctatgatctctaatgtaaaagttcgattaattattaactttaatcgtggacatttgaaaaaatagaaagagttgaaattcaactggaagtttctgtgatttcttctcctaatctccttcctcttcagcccctcccaaacaaaccctaaaaatcatacttttttaaatatatgtatgcatatttttaaattgcaacaaccctgccaaaatgcatattagaagctaattatgagtgaaaataagaaagaatattagtttgatcaatattctcagtggcggactcaggattttgtgcaagcggattcaatcttagaagtatataactttagtcgtaaaatagtagttgtcaagtgggttcaaataaatatttatacaaaatttacacagctttaattctaatttatacatatacacagtattatttttctgtgaagtgggttcagttgaacccgcttgccaccacttggatccgccactgaatattctcatgcatgagatacattaatattgccagtggcggactcaggattttgtgcaagcagattcaatcttagaagtatataactttagtcgtaaaatagtagttgtcaagtgggttcaaataaatatttatacaaaatttacacagctttaaccctaatttatacatatacacagtattatttttcggtgaagtgggttcagttgaacccgcttgccaccacttggatccgccactgaatattctcatgcatgagatacattaatattgccagtggcggactcagaattttgtgcaagcagattcaatcttagaagtatataactttagtcgtaaaatagtagttgtcaagtgggttcaaataaatatttatacagctttaactctaatttatatatatacgcaatattatttttcggtgaagtgggttcagttgaacccgcttgccaccacttggatccgccactaaatattctcatgcatgagatacattaatattgccagtggcggactcaggattttgtgcaagcagattcaatcttagaagtatataactttagtcgtaaaatagtagttgtcaagtgggttcaaataaatatttatacaaaatttatacagctttaaccctaatttatatatatacgcaatattatttttcggtgaagcgggttcagttgaaccagctagctaccacttgggtctgccactgaatgttgcaatcagtaattctaatacagtgaaactaacaaactaagaaaaagaaatacttacaaatgtgaatttacttagggtgtgtttggtataacggaaaatgtttttcgtgaaaaatgcttttcaagtaaatgtttcttgaaaaattagtaatcttattcattttccaatgagattaaaatctcacttaatctcagattactttagtaagagataatcagccgactaatctattaatcgaactaaggcaactccaaacatgttgcatctaatttttcaacgataacaacaataaattcagtaattttctacaagtggggtctgagtgatggattctgaggagggaaagatataccaaccttacctctaccatggaagggtagagagactgattccaatagaccctcggctggagaacagatgaaaaaaagtaatgacaacaagtaggaataacagcaagataaaaagactaaagccaaaaaaaaaaaagcagttaaactttagatagccatagcaatctatgaaaaattggatgactagtaggaagttgaacgtttctctttgtcatactcaactcgactgacaaattttgtaactaaataaaaaaaatctgttagctatgagcggtttagcgacgaagttcacaattgatcttgtttttttgtagtgaatggagaagaattagggatcgtttggtttgaatacaacttatgttgggattagttatcctagtattgtttcttatccgttgtttggtatgctgtattaaaaataataattgtataatttctaagaagatggtataagttatccaggcattaattacctcaccccctataaagtataaattatcccggtattaattttaatctcgagataacttatccatatttgctaaacaaacaaagtattaaggtggtattaaaattttatatcagcaactataatctacttatacctcgtaccaatcgaccccttatagtgtacaaagcttcaaattggtgcgtggatatcccttttttttcttcttttatttctatccttttttaacaatgtcaaaaaaaaattcaaggaaaacatttagccaccaggatttctttttcagaaattttcttatttttgacaagataatgacttttcaagttttcatgtacgaaaatggacacttttgaacaaaaatgagtttgataaataattccggtctagttaggggtaaaagtgcaatttttaaaattgacctgactggctttttgaccatattggtcaaacgtggaccacatcttgactcccaatgacaaatgtcaaaagattatccgtatatttatatcccttttgacttgctcacgtaattaatttcaattttgtaattattttaaaagtggcaaaaagattttatatacttatctatatatttatttatctatactacattaaaaacatgaaagcttttagcaaaatgtcgttcgtcttttttaccctttaaaaacagatttttctttaaataaaatcgtaaataattatttttttaatatttagtactttaaaatcaacttaaattttaatttttatatcttcccttctttgaactacgtaagaatacctaatatttaggacttaaattaaagactttgaaggtaaccattatttttttaaaaagaattatgttcacattttgaaaattaatattccttatagaagtccaagtcaacatagcatacttttagtgtctcttaaagtacatttattatttttatccaaaaatggtgtagttattcaaatttctgttttaaaaggcagaattaggactcgttcggggctcgcctcgaagcggagcactcgtaaaatccctgggcttatgtgtggggcttagttccgtgagacttacgcctcggctattggggcttacgcctcggaatgcccaacgcccaacgtactgggctcgcctaatagaactttatgcaattgtatgtaactaaccttgtaaatcctcaaattttctgaataaatcgttgactattcaaaattactttttcttaatcataaatcattaagttgagagtattttatgtcataattaaaataaaattattgacgttatccactaagactgctatgatagttaattttaaataaatctttcatttaaaaagtatttatttattaacttttgttatgtctttactatataatagtccataattttttataattatttttcaaatattatttttcatgtttacgagatacaatacttattaatttaatagctcagtattagctagtaactatttacaaataattagttatcatggtattgtatggtgaattatgtgtcactttattaacttgttgaaacttaaaaataaatgatgctagagaatcatattaaattgtgaattatgatttatataaattctctttcaaatagaaagcatattaaataaaaggagtattttaagaaaatatcaaattataatatcaaattctttcaagattcattacttcttaagagatattaagatttcgtatcgaatacattacttttgatgtttgagttgtaatgacgttgcgctaatttgcatattatgatatatgtcatacttttcgtattattcatagttgaattatatttataaatattttaaatagattattttttatattttgtgattttaatgtaatttttataattattttttatttatactattttaaaattcttaaattagtaaaatttaatgatttgtggacttacgccccatatctcagggcttacgcctcgcctcgtcagaggtaaaacgcctcacctcacgccgcccctgccttttaaaacattgattcaaattcatgagatttcattgttttttttttatttttttatttttttttaactatggtcttgacttgcgtacaaattttagtttttcaatttttaatccttaataattaatatccacctcattatccaccaacattatactcttgaactcaattcaatttatctaatattagaggagctaaaataatattaagtacaattttatattagagaactttcgtggataagatttcttcctttattaagccagctaaataggatcaatatctatcatccgcaagaactaacatttttgctttagtttttaattttataacttcaacatattattcattaatatttgtataattttttttttgcaattatatatttattaagatgaggtacacgcgcaaggtgcgtatcataagactagtacttggtaaaaagacataagtaatcctaaatagaaggttgaactatatacctaacatttttgaaataaaaatactccatttctcaacttatccatgtctagtaattatgtaatcttgttataataggagtattgtgcgtatctcgattatttcatcaagtgcttttttaccttccatcggtaaaggtacgaaattaagcaattatgtaatccctttggtccatattagttgtcgtgcttactaaatattttttccgttcacttttagttgtcaatttttgattttgcacgtcttataagaaaaaaataatattttacaattttacccataataattataacatttccaaagtctagaaaaataatttggggaatgagtaattaatgataagggtaaaataagaaaagaaaaaaaattgtctttttcttgattttagtatagcagacaagcaaaaataaaaatatatttttagtataatgaacaagtaaaagtgaatggagggagtgtatctgatctaaaataactattacattttccatattcccttagtattaaatattcttgaaagtaaaaacattgactacaagcaaagaaaacttaaaagtgaccctcttattaagtaagaatattaaataaggttataatagtcaacaaaatcctcttattaatagtttcttaaggacgtgtaaaaaaacgataattaaaatagaccaaagaaattaatttaaaaacatttttgttctctttacatgctagaattgcttctcctaaagtactcaaaatagaacttaattggaagagtttaacttccatacacaaacaaaaagtgaaactataaattctaaaatatagcaaattaccttctataacacgctaaaatacaccgatagcataataattcgtaaaaataatactggctaatcagttttcaaactgatcattcaaaaatagctaacgtttacaaagtcattgaataaccactattttattgcgacatggaaagttccagcataatacactgaagatcgattcacctgtgcatgaacaatatgctggaactccaatagcagaaaattccagcataatatattggagattggaacacatgtatatgagcttccaacatattatactgaaccgatatattatactagaactccaatataatatactgaaattatagtatacttatactgaaactctaatataatatatactgaaattctaatatattatgctggaattccaatatattatgctgaagtattattcaaattttgaacagtatttttattcaggctgaaatacgttcactttcaacatattcaagatttcaaaacatatactaatacttgccaactggctggcaagatctatttctcaaaaataatttacatccgaaccataacaagcccacataaaccaagctcactagtctgcacatgcattcatctatattatattacgatatatatcgaccgtaatgcatgaagaaccaaaatatcgacgacgtatatatcatcgcgaaggccaaaaggcgctagaacttaagtatatatatggtagttagtagcagcattcaagacttaattcatagaatgtggccttttttcgggtttcagtaaacatgattcaggcgtcgtggttgtgctggaaatgtctggtggaagtataagccgacagggctgatcctgtcacgttcagtgagtgcttggcaagacatgcacttttctttgttgccagccatattgcccaaaagaatccaatccaacctgaggcacaagtaaaacggtcagtaaagcgggtgaaaactatcaagtttcagctagtttgccgacaaagcacccaaggaggtggcttaacggtcagtaaagcgggtgaaaactatgcgagacgggtttagattccaccaaagccagaaaaaaaacctaggcgatttcttcccatctgtttatggctgggacctgaggtgtcaatgatggggcagaaaagtatgagataaaagcaatgagtgaatccataatgcagaattgtcacaatcttatcgttgattaacagccacacgcaatacaggcaatcaattgtcaaactacaggaaacgtgttgatactgatgaaattgcaaaaacaactttgtgcatcagctactactcagattaaacacatagtcaaagataaaagtatcggtttccaaactcgagagattttttgagtgaaatcttgtttaaattgaactgtaatatagatagttattcccctcctgttatctcagctaatcattcatttgcagagtgaaaaaaggacaaagccacactcaggttggtaaatgacaagttaaattaaaatatgggtgaaaataacatgaaattaaagctgaaatatgaaaaacagaaggagctcaaactggagccggaacagagagaaaaaggtcctttttgccatacctgtagccacaatcacagcaataattgatataattgtcgtagtggaaatgacaaagacagcaactgatagagccccgatataaatagccgttaggcaggcaaagaaaagagccaggaatcctcctgcagctgctaacgacatgagaagagagatcacaatggcattgacagttgccgcgacaaagaaaagcataaagattagcaatcctgtcaaagcaagaagagcaatcgtccccacctacacaaatatttagcagtccaagatacatgttagtctcacaaagttgggagttccaaaacaaaaacaacccagataaatattcatgcctaaaatagcttgcttaggaggttgcacagagaattaatcttatcaatatttgactaattagtttcaagacaaagaaccgggacagtacaagaaactcagacattcaagttcttgaaagcgcagctttaacaagggactgataaaacttgctagttaagaaaggtaaagaaattactccaaaactgtcctggtcatggcattagaattccacacttatattgcacggactctccaaaacagccgccgcaccgtgtcggatcctccaaaaatgcattattttggaggatccgacacgcaaccattgatattttcggagagtccgagcaacatagaaatcagaacaagaattttcttgtactcagttcataaagggtgcagatcgcctaaccacacacatttttgcgtgagtattgagtagtgatgctatactaaatatgtgactaataaggaaccactggaatggaattaattattaccaaaaaagaaggcaaagagagattcttgagttcttggtacacactccctttttattctcctcagtttttatcttcgtagtatttgaaatgtttaacaggctagaaaatgtagctggatcacttgttttattcaatacttgcttcatttgataaatatctcatgaggaatgccaagttagcatgtaaaaacttcagcaggaaatgtaaagatcacacgcacattaaaagaaagtacattacaatacaactaagtcacgttttgagcacatgctgttttctgtttaattaactacctgttggactttcagtttttaattcagctaggtccatagttttggaatgtctacatgaatcatgattcagctcttcttttccacccgtggcaacgactgctcctactaaacgaatgaacaaactttcaaagtttacttaatgcaaatgatcctaaagggctaacgaggactgactcacttcaggaacctttcctctcccagccatttcggatcaaaagatctaaagaagcacgtatatccatataataatggtgcattccaaggtgtggaatgcgagagtagggatccataattgtggtcacgtgaacttagataaaaatgataagcaaagcgttgacaattccaatttcagcatatttgacgaaattatacagagcgtgaaatgcacctaagattcacccttctggctatgttctatttgaagaaacaaaatgaaagcctttcagagagttgactgactcgatagacagtctaaaaatccaatatagtttagaacaaagaattgccaacggttctcttttgctacatgatcagttcatttagtggttttggttgtactagaattcaaagaaaaataatggctgtcctatgctacctaggcaaaccacaaaatagtttagatataaatcagatgagataacttaaattttagaagaaacaagaaaaggttgttaggtatattctataaaacaaaataaatggtaataggagttaaggtcgctatatcgtgtcttccacaattgcacatttaggaccctttccccccaaaaaaaaggtgcttcttaatataaattctttttaagttcataaaaatttcgtgtaaattacggaatgacatgtatggtaaccaatgtgggacttacctcaaatttcacgtgtatcacaaggtcctaatgcacctgtttgagccaatgatcttggatgtgattaagctatctctttgtcaccctatatcgaaatatggatatatgtaatttccttttgaaacaaatatgttgtaactaactgtcaaggttacactggtcactagatcttataattgtatcgtgttcatttaaaatgatgctttcccaaatcccagcttcaccaaaaaacagtctaaagtatatacattggagtgaaagattacaaagacgatggagggttgtttttttacccctctgattttggataattgacaggagcgaataaagaatacctttcatgtcattaagatattgtttgtcaggacatcgcttttctaacatgcctctgtctgcaaaatagtaccttttaaaagctaaaagatactgaacagttttcatatttataaagagcaatcagaaaattaaaaccaagcgaagaccatgtttaggaaacatttttcttctttgtattgttatgagaaaaatagcaaaagaatgagaataatatacgtggttatttttctgtttccatgtgtatattctaaaagtagtcgcagaaataatctaacactagtgcgtaagaaactgggagaccaatgggtcaaagacttagaaaaggtaagcaaataatgagagatagcctcataatgatgatattgagatgcgaatccgcattttgcgaagaaattagaagcgaataaatcactacaataggtaaacagcaaaatataccatcaggttcaaagaataggggagtaattcgtgtcacttgatgtatctcgcacttctttaagacacaaaattgccaaagtgcacttttttataagtcttcagttcaaaataactgtgttgatgcatatgtcaaataatattatcaaaggcgaaaagcgcaaaaaagctctaatgtccattggggctttaagcgcaaagcgcaaataaagcgtggactttaatgaaaaaaggcgcaactggagaaaaagtaaaaatatgtatatgtagtctaagaccaataattataagcatgaataacaagtatatggacaacgaaattgaaaaaaaaatttatgataaagtgaaatatcaattgtttaacgtcgccttttaaggattacactcattggcaaggaaaagtatgtcttagagccttgatgcgacactaaagcgcccacaaagcgaggcgaagcgctcgatatgttttgagcctcgcttcagggcttaagcgcgcctttgacaacactgatgtcaaatagggggaggaaaaacagatctagaatggccagaagctcgagaaggattttctattattaagtgtggatatgttaggagagagtcaacgagtatgcgatcttttatagggtcagaaagcaagcaatatgttctaaatggaaaagggatgttaacaatgtcagcaagtttacagaacaagccctatcttaacatcctttgttttgctctaaatttgaagtctcatagcaaatataacaataaagtcagcaaaaatactgaacataagcaccctactcagtattcattattgtagtggtatacttaatactttaacaaaaataaagtgatctttactaattatgctctaccgaacagaaaaggactaaaggtccaattattggcaaaaacatagtcgttacaagtcaaagacagaaaaccataacagatatccaagtaaactcaatatacttaggcattgtgctatacttttccaaagtagagtcaataacccaatattattccagtagttcgattggacttggatcagaggcaatgaatgacaaatcagcaatttctaaaactacaaggaacgattacaatcacaataacttttgtcaaaataaatcaccagcgaaacagtttcttacgaaatttataccttcttgtttcccttctataattgtagtttgtggtgtctactttatttccttttccaaactgatgtgtttatgttttccttgagctgagagtctatcagaaacaacacgtgtatctccacagtgtaggggtaaggtctgcgtacacactaccctccccagacccaacttggggattacacggggtatgttgttgtcattgttggtctctaggaaatcaaattcacaggacacaactgcatttctccccttaaaagcttaatctctgatataatctttacaactaactgaacttagcttacgaaacaagaaggaggtcacggagagggttctcctcagctagtctttttttttattttaaaatcagtctaattacaatctttgatagaataaattgaaatccataaacaactagcaaaataagacaatcagagcaaacatcgaattaactcttaaaaactgaatctttaacataatcatttcaaaacaaaatggatatactagcaaaataagccaatcagaacaaaccccagatcaaatttacactaaaaaattgaatctttaatataattatctcaaaataaacaggaattacttacagaaacaacttcaaaatcagcaaataaaggcaattagaacaaaccccagatcaaatttactctcaaaaactgaatctttaacataattatctcaaaacaaaatggaaatactagtaaaacaagccaatcagagcaaaccccagatcaaatttaaactaagaatttgaatctttaatataattatctcaaaataaacaataattaacttacagaaacaactccaaaattagtaaaataagccaattagaacaaaccccagattaaatttactctcaaaaactgaatctctaacataattatctaaaaataaaatggaaatactagcaaaataaaccaatcagagcaaacccccagaacaaaatttacactaaaaattgaacctttaacatagtgacctcaataaacaaaaacccagtaaatcccatcactgggtctggggagggtagagtgtacgcagaggaggggttagagaggctgtttccgagaaacatagtgacctcaatacaaagtgaaaatactagcaaaataagccaatcagagcaaaccccagatcaaatttacactgaaaaattgaatctttaatataattatctcaaaattaccaggaaaaaacttacagaaacaacttcaaaattattaaaataagccaatcagagcaaaccccagatcaaatttacactgaaaaattgaatctttaatataattatctcaaaattaccaggaaaaaacttacagaaacaacttcaaaattattaaaataagccaatcagagcaaaccccagatcaaatttacacaaaaaaattgaatctttaatataattatctcaaaatatacaggtagaaacaacttcaaaattagtaataagccaatcagagcaaaccacagatcaaatttacaataaaaaattgaatctttaatataattatctcaaagcaaaatggaaataacttacagaaataacaaggaggcacgtagagggcttcctttgcgagtccaagaataaacattatgagcagtattctttgaagcttgatgtagcaaaggaacattttcagaaatagccactttaatcctctgaattaaaggatcattattattattatcagaagagaaaattgcagacacaaaatgattgaaaatatcaaaaagagtaacccctttttcatcttttgaatatccatcccttttgatttattgaaatttgttgaatcctcttttgtttcacctataatgacttctccattagatttttcttcactagtagtatcctccatcaccatagccaaagcttgaatatctcatccaactgctgcactcacatttggtcaatgaataatttaatggatcttaatttaaggtgtacaactttttcttacgtttgacggttaaataaaatataataagttgatttcaaaaggttgtgtttatcctattctattttacatgacggtatattgaagaggtgtgaatttaagataataatatagttaattattattgaaatattagtttgatactgctaaaatttaagaagatcaataaacttaaatctaaaaaaatataataacaatttcgcctcaatcttaagcaaataaccgtatataaattttatctattcatatcgctccatttaaacatattttcatttaatattgtataagatagaaataaataaaaacggtagaggaattttgacataattaaaagatttctaaaaaatataagaccaaaatgacataattgaaggtaaaagagaggggtgaattgtggtctattacaaaaatagtcagactaacaatgattttagttgattagatcaagagcagagtataaaataacagtaaataacacataacaattttatattggttcggtaccggtgtggtagtttttcttgggtcacaagagttcattttaaatcttgaaagtattacaatataaatggttttgattcgtttaccatcaacgaagtatagcaacaatgaatcttgagtaatgacacaactctcttttgtgttctaaaccttcctatcttttgagacactgataaactaaggattacagtgttaaggctcaaaaatagagagacttagaaaataacgtgtgtatttgcacaagtcttccatttgatcttcgcagacttcttataggggagtagatagtcgttgagccttgaccaaaagtagaggcacgagatcttcaaagggatttgacccaaggaatgcctcttcgaatccttctcttgggaagggccggattcgatcgtgactttccttgtcacatgcttacattgaggagacattcaagccttcgattgatcttaattaaggcaaccagatatttgctggaaatagcgccttgatgtgtaatttgatttcctttgattgatgccgaatggatgtgataaaatttgattccttcttcttgttcattaatacaacaatcacatatttggacaacttctcattaggttttctttccttttgatgatttcgatttcggcaaacaaggtaagtgaacattgtcatcatcaaaattatgaattttaacttaacaataatcaaaatttagtcttaactcatcggtatattatatataaatctttttttttttattctgcattatcattttacccttgacttccaaatagattgtaggttttttgagaatttttttttcatatgatttaaattttccctcgtcctttttaacatttgcattcaccataattttacacttatgaactattgtatctaaaagtccacattaaacataataaaattagatcaataaactttttttattttataagcaatatgctattgcgacagaaagtgataatctataacctgtttaattttatatataattgcatatttgacttaactttagtttctctgcaataatcccgtctatgatttttgatatcatatttcgtgatcaataaaatttaaccacctattgcttgaatgcagctatgttggtttgttgttatatttgtgagcatgtaatttttaacccaccatatactcctataaaaaatttcaataaaaataatctaatatataaattttgttgatttttgtgctatttgtgaaattattttgcataataataattcatcttttcaaattattaaatgatttaaggttgcattaattgggtacaccattatcatcatggaagtacaaaattttcattgataattaattggactaatagtaaacaaaagggattaattgacataatgtagagttagtggtcaaattgtcaatttaatcatctttagatagcaaaattatatatttaaatttttaggagtactaaatcaagtgttttactcttaattagtttataattagacaaaaaaataaaatcaaattaagtatcatttttttattatttattagagattaattaaactaattaggattgattagcctataatatcaaaataggacctgggccaattacacccaggcccaaaattgcacccaaaatactccagccaaataaatcaacccagtccggacataaaatggcgtcgttttggtcatttttgaccccagccgttggatcatcttgatccaacggtccagaaccccacaactttttaatatttaaatgtccaaacctcaccccactaccccattttcttaaaattccaacaccccccttccccccaccgtctctctcttctctctcctccaaccatccgccgccgccatcaccgccagctccgccggccggaaatcgcctccggcggcggagcaactccaaaacaccccaaattttcaccaaacaatcctctccttcccctctatcaccccttaggcttagttttccaaaaaacctcaccaaaattcctagatcttaaatctaagaacggaaaattttagttccggttaactcactattccacggtccaaatggctcaaaacttgcatgagtcgatagctcttgacaagagctatgattcatgcgggtttgaactattttcaaacccgccggaatctcccggaatccgggtcaccgaattcaaccatttttcaagctaaccggtacatcattttccttttccatcccttcaatttttttagagtaaaaccagtttttttaattttttccttattttactaattttattttttattttttttctcgcgttaattagtttctgtttacaaattaattatctccatgcatgtttaattagtttcattgtatttagggtttcttaagtacttaacatgtgaatctaacttggtattaagtacttaattgaataggatttcatgaatgttcttgctagttgagtagttaaattttatttatatgtttgttgtttgattattgcatattagttgttagcactaggtttgccgttaagtaactaattagtctaaaaattttggtttaactcttagctaaattagaatagaattaatcttggtctactaagtttgtataacacatttttcaagacaagaattaacctaagtctaaggatttagcttaactaacctaaaggtgattaatataaaatcaaccttttattagcaataaagtttagctattagttaattagattagaatgaagttgtttattaactattagtttaacctaacataagactcttctaaaaaatccaatttattttagcttaattaattccttcaaacaattagtttagcttaaccaattttctttaattattcccaagtctaaggctaactaactttacctcttaaagaagattgggtctccaacttcactaagggttagattactttgtaatcatccaaataaaataagttggttaatatcaattgcttagaccaataattaattaattacttggtaagccaagagttagtctaattcttaaagttctaactaattgaattgattaactaattaaggataagaattagttaacctttaataaaataacaaccttaatactaaaggagtaattcaaaagtattaaaggttagtttaggaaattcaagtgaggaatcttgggtgtaacaacccaagaagcttctagaattaggataaaaccagaaaataattctggaaaaatcaaaaatcagatttttttagggctaaaacagtaattttagaagaggataaggctgtaaaacaatgaactttctagaatatgtacagctgtcctagctggtacaaaaagatgctgaaaataggataaggacagctgtagttgtactatttttcagattttaagaggataaggtagattcctattggagctgaaatttttcctatataatctaggatattcagctgtcaaaaacagattttctggaccataatttcagatttttactcttcaaatattttcctaaaaatactactcattagaacctgaaatggaggagaaaagagaccaaaaaaaaatctatttttctgctttgtttggccctttaaagatagtttttagctgctgaaatttccagatttcctcactattttttgctgtttatccccggggataactgctgttttttctactgcgtttaagcttcgggttctcatttctttgacctttatttggtctggttttctttttgctgttctcattcttaaaggtatgtaaaccattctatcataaatgaaattttatttgttgaaataatcatgaatatttgctgaaatttgccatgcatttttgatatgtgtgaatagtttaaggctctttagaaatatataaacatgtcatgttcatcccttttaatttgacttgcattaaggaaacgaatctgaccctataatggtcagattccctcctttaagaatgcataaagctgtctcactttatttcctctttaactggtaaaatgcaggtttcaaaatcatgagccattgaaactgaggcagtttatagtttaaaaaatagtaggattttatgtacaatctttatatggccatgtataattttaattttttgttaaactagctatattcctttcttttcttccattttagctgtaatggactgtataatcgtattaatttcagtagtttatgttttcacgtaatttcagcacctaaaactgaaaatcccggctatattagcaaaattttttttatattttgctgttataaacatatcgatttcaaatttaattgaatgttcttcgcaggaattaaaattttttaatagactatatatcccttgattttggattatgacactaataggctattttgtaaaaattagtgatttactagttaaaccgggcagatttgtaaaaaagtccaacgggcccgagcaagtctacacctaaggtcattaggcctaagggtatgaagcccaaagttttagagttacaaaccgctttaaatttaatataatatggaacacgttaggcaatatgattattagattgcaaccgagtttaaatatcgttagaattcggccaaatactgttattatattttaaactgtccaaaattttcagatttattttgttttaaatttcgaaatacctgaatatagttttagcatctgtaatgactagatttagcagtttattgtttaaaatttttttttctgtttagttgttttaaattttgatccatattttttatttgtatcattaacttagtagtgtagagttaaattgcatgaacttcttctttcacaaatagccaaagtcaagattggcctaaagtgttaatttctaaatgggcttaaattaggccattgccaaactcttacttatgtttagaataatatcatatatgtttttttatttagaaatattctctaggttggtcttattgatttaatttaggaatttaccttagatatagtaaacgttcaaccttttctttaattaaatagtggatactttagcttaggaaacaattaacaatcaaagtatacgttcgtgtaactttgaatcaaataactaaaatacacccctttctcaaattgtgtatacgtttcacgtaacaaataaagattaaaatgaacactcgtagagacactttcgtacatgcttgcgtgacgtatttttttaattgaattaagtgtcatgaattatgtacatgttcgcatgacatagtttttggcatatccaatttcaacaggctattcatacgtaactcgcttttgaataattctttaaatattgaataaaaaaaatgtaaaatgcatataggtattaaatcagcaatttaggcaagtttaatcattaagcgaccgtgctagaaccacggaactcgggagtgcctaacaccttctcccggtgttaacagaattccttacctggatttctggttcgcaaacattttaaacagagtcaaaatttcctcggtttgggattttaataaatgaatggtgtcccggaacaccgtaaaaatccgggtggcgactctgaaaattaaataaattaatcccaaattcgaataatgtcacttcaagtggaaaaactcccttattgcccttaccggtaaaaaaggaggtgtgacagctctggcaactctgctggaccgaacccagaatctctggttcagggttcaagaattcgagcttgttaagatgattttatttggctttattaactgtgatattattgttttgctgtgccaaatgtgctaaatgccatctatttaccgctttgatatttatttgaactgtattaaaatgtcttcttacgcatcccttctgagtcttctaaaaattggtgcacacgttcgcgtggcccgcttttctgttaaaggtcataccaagtaagaaacatggggatggactagtcactaggccggatagcctgtcgtgctaccggacgttgctcccaccccgactcgagttgtccgctggggtaacaaggtctagaacaaagcctcagtttaacccctagaatgacaaaacctcatgccggatccctagtaggaacgttttatctgcatcataagcatttttgacttagtggggctcaacacagggttgggtccgtctaggacaggtgaaccaaacaaaagaccatcctgatacatcttacttgctacgtgcacaatattttgcctcggtttgttgttgaccggctaaataaagaaaggaaaaacaacggaaaaaccaagagtgagggagattaaaagagtaccaattttttttaaaaagtctaaaatttgaaaatttctcgaaactctgtcagaatttctcgaaaaaaataaagtttttgaaataagtcaacattttttttagactgaccgaatacgcgggtctgattctcaccggatgtgggacacgtaggcaaaccttatcggtgccgaccccgattttccaaaaaaatataatatatatgaaaaaccgacccagcttcggtgaaaattttgtcccgttcttgccaaaatagccttagaacattttttaaaagggttattttcaaagaacagatctgtcagaacatttttacttcaacctcaatctatttaaaaataagaagaggctacttctgcaaaaaaatgaccattttggttattatgtctcaaataaccacctttaggtcaaatatcttttactggctttttgcgaaaaaatttgttgttcgttttttgacaaaataattttaaaaaaaaaaccccacttatccacaggtccaagatgaacactgttcagactccagaattaaacattgtagaagaagctccactacaacttcaaatgtggtggcatgatttagaccaagacggtaaagaatgggtaggcaaacagctgggagctcttgtcgatgttatgaaagttaagcccagaaatgacttaatcaaagccttggtcacattctgggatccagttcataatgtgttccgtttctcagatttcgagctcactccaactctagaggaaatagcggggtatgcaggttcgggtcgggattgagaaaccaacagcttatttttcccaggcccatgtcggtgcggcggtttttcgaatttttatctattagcagacaactcagcaaaaacagggtgatcgatggttgttgctccttctactttctatattctagatacggtttccccgatggtttcgaaatacatgaaaaaggtttaacaaacaagcaagacaaagaaatttggaaggtccaccgcagaacaaccttcatagtagctttcttgggggtttatgatttttccaaatgcaaaagggaccattgatgttcgagtagccagaatcgcccaagttttgactgaaaagaaagatcacaccctggctccacttatattgtccgatatctatcgagctttgactgaatgtaaatcgggaaagacatttttcgaaggtcgcaatatcatcctacaaatgtggttgatcgaacaccttcgccatcacccgaggtttatgagctacggtcctgataaatccaacctcatcggaagctatgaagaaagaatcaaagattaccattccccggaaggggtggaggcttggattgaacatctaaaaaacttgcgcgcggaacagatagaatggactctgggatggctaccggtcagggaagtcatacacatgtccgccaccaaaaatcatctgctgttaatgtgtttgaaaagtgttcaaccttatgcgcctcaaagggttttaagacaactgggccggtaccaaatagtacctgaggatgaagatttaagtacccaagtgattgaattgcatccggaagctcctttacccgaagctctcattcaacaaagttggagtgggtgtcggtatttgaaggaagacactcaagtacctaatcttgctagaggtgaggtagacccaggttatgccaggtggtttgaaaagagaaactgcgctaatgaagagtccgagcccgaatcacaaaggcctcccaaaaggccccatgtccaagctttcgatgacaaaattcaagaaaggctagcttggggagaaaaggaaaaagagtatcagactaccatccatgctttgaaagaaaaattaagaaaccttgagtttaataatgaaatgcaagcacaggtagttgaaagtgaaaagcgacaattaacccaagaaaacgaagtgttacggcacaaatccggaatctgaaaatagctgcggaaacacaccacatagaagtgaaagagatgagaagatcatcagtaatttaaggacaaaagttcatgaatatgctttgatttggctaaagctgaaaaagacctgtcagacactaaaaacagttagcaaaaggagcggaagaacaggctcatcacttaaggcaaaaatatggtaaagaaatggcaatcttgaaagaaaaactattcaccatgggaaacgagatgatcaaacaggctaaggatttcagaatagaaagagaacactgctatgcccaagtgggccaattggagggaataatacaagagttacaggatcagaacaacagagatgcccagatattagaggctcgttcccaacagatagggcgtttgcttcaagagaagggggttatccggaatagaatcaaagaaatagcggattatgttgtgcagaaatgccatgagtgtgagaatatgactgtatccatgttttttgccaccatgatgatttttgtccaccaagtaatggatgatttggaaaggctccaagaagacatcgcccataggcctgccccaagaccacaagccccgagaagacaaccagaagcccttctttactattaatgttttagttttcgagtctgtactttactgttttctagaatgttaagtgttgtgtcttttatccagagtttgtaatgtttcccttataagtgtcagtaacttgagtctgtattttcctttcatgtttatcagtattttcaaaatccttgaaatgaaagaatttggttatgaaatgaaattaccttttttcttgaactacgtaatgatctgattcatgcggcgtcatgatacgtaggcaatccacctaggattcgatcataaccataaaggagagataaagaaaagaaggagaacaataaagtcgggatgaaacacaccaccgtcgcaaacatgttagaaaaaaacttaaatgtttaggtgcattgcatcccaatgtgtgattccttttatgttaatacctcaaactaacctgtttgcttcatcattcttaaaggttattattttcatttaaaggtagttggtttacggtggtattctggcgacacatccttattttacaagatctaaaggaaaaatcagaatgacatccgaaagtcacctggctattgttgaacctgaagatggccctacatcggttatttcgccaacagaatcggcggtcgccgaggaaaacagaagactaagatgccgcatgttggaaatgtgggatgcttggtccaatggtagagagccgcctaattctatccctggtttccctgagctgattccaagaactggagggacttctaatgttcccatctcagtaccaaacccgttcataccatttgggtttcccaccatgacgtcaaattacaccggaatgccttctgaggtccgcccccaggcaccgtcttctggaacatcctttgctatatctgctgcaccaccagcaaccagtatggcacaacctaccgtgctacgacagagttttgagccgtcaagtttcaccttccaagctccccagttccagatggaccctactcgggtcactccaaacccttatccacagtacccacaaattgaatctccggtggacccggacaaaatcctgagaaacatttgaacaggatgaaatgacccagaaaatgaaaagtattgaacagagcctgaagaatatacaggggctaagtggccacaagagcgtgtcctacgctgacttgtgcatgtttcctcatgtgtatcttcctgtaggtttcaaaacaccaaagttcgaaaaatacgacgggcatggagacccgattgctcatttgaaaagatactgcaatcaattaagaggggcaggaagaaaagaagaactattaatggcatatttcggagaaagtcttgccgggatcgcatcagaatggtatatagaccaagatatttcccgctggcatatttgggatgatctggcccgggacttcgtgaaacaatttcagtacaatgtggacatagcaccggacagaaactcgttatccaatctcaagaagaaagtctccgaaagttttcgagaatacgctatcaaatggcgtgaacaggcatcccgggtaaaaccacctatggatgagaacgaaatggtcagtgttttcttgcaggctccggaagccgattatttttcaaatatgatgtctgccatgggcaaaccgttcgcggaggccctcaaaattggtgaaatggtagaaaatggcctgaaaacaagccgtatcttgagtcaatcagctctaagagccacctctcaagccatccagagcggctcgggaggtttagcaggaaggaaaaagaaagatgagggagctatgatgacttcagacttaaaaaattcacggcaatttcagggttatgctcgccccaaaattccacatcattattatccctcatcaagatatagcatatgctgtgcctcaccacccttttgcagtgatgaatgcccaaccatatcctcggccgcaacaacaacaatataatcaaaatcgagctccacctcccagaaacaaccttcctcaccaagctccatataatccccgacctcctcagaataactaccaaaacaataactgtcttcgtgagccacccaggaaaaccaacttcacacccattggagaatcttactccagcctttttccaaaattggttcagatgggtcttttgcaaccggtacctccaaacaggcagaatcccgattctccatcataccggccaggtacaagatgtgcctaccattctggggcagaagggcatgatactgaggactgctggacactgaaaagagcagtagaaagcttgattgagcagaaaaaagtggtgttaaggacgaggaagtccccaatgtaacgaacaatccattgccagcccataacaacgggcccgtaatcgggatgatttgtgaagacaaagaatttgatcccgcattaaaagccatcatttccatcgcagatgcaggaaagaaacctaaagctacaaccaaagcagtcagcaaggaggaagaataaagcctaccattcaaaatgaaggaaagcccgaggaaacatagaaagaattgatgttagctaaggaagctatcctctatgtcccaagagctccccgtaataggcagatcatgttgagtcctccaagaagactagaattgaaatcaaactcaacaaagctgtatgtgcccaaaagggcgtatgtcgcaaaaagagcttcctcttcaccacaattggatgaacccttgataatcagccgcaggccacaagtcccaataaaagacactactgttatcccatggaactatagtcaagcattagttacttataaagggaaggagatcaaagggaaataaacgaaacaaacccatctgggaagtatcacaacccagaaattttaaacaaggccaaacgtttccccctcaaaaggcctgctactgctgaggaagcttaggaattcttcagaaagatgaaaatttctgagtatgctgtggttgaagaactcagaaaaactcctgcacaagtctcactactatccctgttgttaagctagacaagcctaaaggtatttctaaagacgctaaacgaggcgtatgtaccaactgaaaccacagtcgaacaattagagaggatgacagaacgtttcttcgaggttaaccaaatttccttcagtcgaagcgacttacctcctgagggagcggctcataataaggccctgcatttgacaatcaaagttgaaggatactatgtaaaaagggtcatgcttgatggaggatctggagtggatatttgtccattgtcaactttgcaacgaatggaaatcggcaccgaaagaatcaggccaaataatgtgtgtgtccgtgcttttgatggtattaaaagggacactgtaggggaaattgacgtaattctaaccatcggccctgtggattttgaggtaacatttcaaatcttggacatggacacttcctataattttctgctaggaagaccctgaatccatgctgcaggggctgtgccttctaccctccatcagatggtcaattttgaacatgacaatcaagagatagtagtccatggagaagatgaacaatcaatctatagagacccctcagtcccttgcctttaggcaagagaaggaagcgaaaacattgtgtatcaggcttttgaaatcgtgattgccgatcaatgtgaggaaggcactccatgccctcaaccttgtttatcaaatgcatcaatcatggtcaccagcgaaatgatcaagcacggacataagcccggaaaaggactagggatagctttacaaggcatcacagaacctatcactttgcctggttacaagaagtcttttggtttaggctttcaagccactactaccgatgaaaaatgggctgagaaacgtaagaagaatggatgggtgctggctcagccaatcccgcacctcgccaaatcctttgtcaaaccaaaatatatataagaagaagaagaagccttcacggtcgaggaaattggagagatttgcggggcaatgagacaaatgctctatgaggttcacatggtccagccgggtgaaggctcgagcactgatgaggtgcaatatgtgggaccaaatgccaaattgcagaattggaaagctactcccttcccagtcaggcgggaatcttggtagttcagttttgccatcctttctatactctgagttatttcagggtgtaactcgagtgcttttaattccattgtcttttaaattctgatgtaaaacccttttatcttcaaattcaatgaaatgaaatcaatatttcatcgtccatgaatcttcctttatcttctctgatctttgttattcttttttttttcaatcccaataatgcagctttaaataacatgacatgcctgcggacttcatgcctagatcttaaaacgccgtctaactgtgaaataatgagtcaagaatttgaatatgatgaagatgaggcttttagagaaataaatcaagaattggaacaatttgagaataagcctaagccaaacccaaatgaaacagagccaatcaacttgggtgattcacaagacatcaaagaaactatgataagcattcacactgagggaaaaaccagagatgccttgatccagctcttactcgaatttaaagatgtgtttgcatggtcttacgatgacatgcccggattaagtgtcgatttggtggtacacaaattaccgactcatcctgattatccaccccgtccaacaaaaacaaaggaaattcaaaacagacatcagtgacaaaattaaagaagaggttaccaaacaattaaaagccggtgtaatccgagttgtcagatacaccacatggctagctaacgtagtcccggtaccaaaaaaggatggaaaaattcgagtatgtgttgattacagatttgaacaaagcaagtcctaaggacaatttcccgttgccaaacatccatatcctggtcgacaattgtgccaaacatgaggtacagtcatttgtggattgttatgctgggtatcatcaagtcctgatggatgaggaagacgctgaaaaaacagccttcaccacaccatgggggacctattgttacagggtcatgcccttcagtttgaaaaacgctggagcaacttacatgagagctatgacagccatttttcatgacatgatgcaccaagaaattgaggtgtatgttgatgatgtgattatcaaatccagaacccaagaataccatgtccgagatctgagaaaattttttgagcggctgcgcaagtatgatttgaaactaaaccctgctaaatgtgcgtttgttgtaccatccgggaaactcttgggtttatagtcagccggaggggcattgaattagatccaaccaagataaaagctatccaaaatctgtcacctccgaaaaccaaaaaagaggttatgagcttgatgggaagactaaactatattagccgttttattgcacagcttacaaccacttgtgagcccatatttaaaattgctcaaaaaagatgcggctattgaatggacagatgaatgccagcaagcatttgataaaatcaaagaatacctgtcaaatccaccagttttagtcccgcctgagcctgggagacctttgttcttgtacctggctgtcttggagaattccttcggctgtgtcctcggacaacatgatgttaccggaaagaaagagcaagccatctactacctgagtaagaaatttactgcatatgaagctaagtacactttgttggagaaaacttgttgcgccttaacttgggttgctcaaaagctcagacattatttattggcgtataccacatatctcatcacaaggttggatcctataaagtacatatttcaaaaaccaatgcccacaggaaggttagcaaaatggcaagtcctgctcacggaattcgacatcgtctatgtcacccgtacagctatgaaagctcaagctttggccgatcatctagctgagaatccggttgatgatgaataccaacctttaaacacattttttccagatgaggaaataaactcaattgagataactccaggagacaccaacacctggaaaatgttctttgatggagcagtcaatgcaaaaggtgttgggattggggcaatattaatttcgcccacaggacagcattatccagccaccgcccgtctccgcttcttctgtacaaacaatactgctgaatatgaagcttgcataatgggcatgaccatggctgttgatatggatgtagaggaattattaatcatgggggactccgacttgatcatcaaacaagcgcaacgtgaatgggaaacgcgggatattaagctccttccgtatagacaacatgtggaggatctcagcaaaagattcaaatccgtggagttcaagtacattcctcgatttcacaatgagttagccgatgtattagccactttagctgcaatgcttccatacccgggcaatacccatattgatcctttggaaattcaaatccgggaaagacacggttattgtgatgcagttgaggtagaatccaacatccacccgtggtatcatgatattaaaagattcttaaaaacaaaggaatacccagaacaagctagtggggatcagagaagaaccattagaaggcgtgccagcaaattctttttaagcggagaagtgttatataaaagaactccagatttgaacttgttaagatgtgtggatgccaaagaagccggaaaaattatgaacgaagtgcactcaggagtgtgtgtcccacacatgaatggatacgtcctagcaaagaaaattctgcgggcaggatattactggatcaccatggaaaaagattattttcgttttgtccgaaagtgccatcaatgtcaaatacatggcgatttaatccatgcaccaccctcagagttgcatcctatgtctgcaccttggccgttcgttgcttggggaatggatgtcattgggccgattgagccaaaagcctcgatcggacacagatttatactggttgctatcgactacttcacaaagtgggttgaagcagtcacattcaaagctgtcactaagaaggcagtagtggattttgtgcactccaatatcatttgtcgttttggtatcccaaaaactatcatcactgacaacgctgcaaatataaacagtcacttaatgagagaggtatgtgaacaatttcaaatcacacaccgtaactccaccccctaccggcctaaagccaacggcgctgttgaagcagcaaaaaaaacatcaagaaaatcctcagagaaatgattcagagctctcggcaatggcacgaaaaattgcctttcgcgttattggggtatcgcaccaccgtgcgcacatcgatcggagccacaccttatctattggtttatggaactgaagccataatacctgcagaggttgaaattcctcccttcggattatcgttgaagctgaaattgaggatgatgaatgggtaaaaacccgactggaacaattgactctgattgatgaaaaaaggatgactgcagtctgtcacgggcagttataccagcaaagaatgacccgcgcctataacaagaaagtgcggcccaggaattttgaagtagggcaacttgtcctgagacgcatcctcccacaccatgaagaggcaaaaggaaaattcgctccaaactggaagggtccctacataataaggaaattgctgccaaaaggagcattatacttgggagacatcgaagggaatgaccccgaaataactattaatgcagatgcgattaaaaggtactatgtttgaccttttatgacattaatactctccgtttggaatgacgaaggctttcttcttgctacccgccaaacactattaccctttttgctaactctttgaaccggttaccttcctttgattaccttctttggaacctgaaagtgtcattgaaaaaaaaaaaaaaaaaaaagaaaaagaaaaagaaaaaaaaagaagaaaaaaaaagaaattgaaatgaaaaaaaaaagaagagaaaacaaggaaagaaaagaaaacaaaacaaaacagaagaaaaaacaaaacaaaaataaaagtacctgaactacatttgacttgattccgaaaggatacgtaggcaacctcacccaggggttcagtcacagccaaataaaattccacatttccccaagagtttaagctggggcaaatgttgtgataattcgacggtgttttcacctaaaagtttccaaagttgtaattcaatccaaattctttttacccaaaatcctattcaagtccttccgaccaatcggcaaaggtgaccaaaattgaaggatacagttatttggatctgatacaaacaaatgagagaaataaaatgagagagtcttatcggtgaaaacccgcaaagggcaccgtgaggcgacggtaagaagagaaatcgaaatgagagagtcttgttggtgaaaactcgcaaagagcgctacaaggcgatggtaagaagagaaatgagagaggttagttggcgaaaacccgcaaagggcgccactaaccgaaaataataatgggtcactgatatggacacagtccggggcaaggtttctcaatctcgaaatgataattgtggtgaatttctgagagcggacggtttacacagatctggcatccagtccaaaaggcatgtcatgttcattgaagtccgcattgcactccagataagtccttctttcctttccccgaaagggatacttttgtttaaaattcggcgtccattctattattgattttcttctgaatctctttcgggctaactctgctaaaattaagaaaaaaaagggatggcaagactgatttacgggactctcatctgatacgggctagcatgcagaaggcacccagcctcgtcaggggcctcgagtcgatctcgactgaccatagcggccgacgcttcaagctcgaaacctgtgaaaggagaaaatcaaatgaaatacctgcaaaggcaaacgaagttaaggtttgagcccccacgtggctaaactgtctcgacgaaaatctgaaaagctgaaatattcccaaatgtttggaaaggccaataaatacgaaacaaagaaatggttgattcatacgcaactagtccccacagtaaagttcaaggagccaaaacctcaccaatgctccgatacaaaaggaaaacaagtcaaaagagaaaggcttataaacaacagcataacctgttgtttatatcggcataacccgatgatcttttctcaacaacagcataacctgttgattcttcacaacaccagcataacctggtgatctattctggcaacaacataacctgttgatccttcagacaccagcataacctggtgatcttttcttgacaacagcataacctgttgctcatttcccgataccggcataacccggtgatcgctttccaggcaacaacataacttgttgatccttcccaacaccggcataacctggtgatctattcttcttgacaacagcataacctgttgctcatttccagatactggcataacctggtgatcgctttccaggcaacaacataacttgttgatccttcccaacaccggcataacctggtgatctattcttcttgacaacagcataacctgttgctaatttccagacaccggtatgacccagtgatctctttccgggaaacaacataactgtttgatccttccccacaccggcataacccggtggttcttttttttaacagcataacctgttactcatttccagataccggcataacctggtgattgtttctggtgacagcataaactgtcgatctttcccaacatagggtctctaatacctagttgattttacttcagacatagggtatccactccttagtctacattttagtctgggtataccattcccgacctttcattgctttaaataataaagtagtattagatgttattacaataactcacgaaattgtcctagtaaagctggggcaggaattttcgttcgttttgattttgtgcagagtgcaatttaggacaatggattcgagacgagcaaaagaagaagtttcgatccagaacaaataaaggaggaaaagaaaaggtcaaacccaaagtacagaagcaggaaaaacatggactgttaaggacgagattgaagtcatccgttctgaatagcttgccttgattcgaaagacaaaagatgaaaccaacattcacggctaaccagcatcaagattcaggtcagaggtggcaaaagaaccagccaagactcaaaaccaagcattagaatctattgataaggaatcttgtaactcatagtttataggtttggctagtcttttgtttttgttactttggtgtaataaggagctcagcagcagtaacagcagcaacagcagttgaaaccccagtcactcggtagtcccagttaccaaaacttctagaactacactgacctgattcctttacagccaaggatatgtaggcaacctctgaagcaaggttcggtcaaactttttaaaatcgcttcacatggagtatttgaacgggtaaaagttgcttgtagctgctcactttgtctttgcccgaaacctcttcgtgtttccgagcaaagaggggcagctgtgagcatgtaatttttaacccaccatatactcctataaaaaatttcaataaaaataatctaatatataaattttgttgattttgtgctatttgtgaaattattttgcataataataattcatcttttcaaattattaaataatttaaggttgcataattgggtacaccattatcatcatggaagtacaaaattttcattgataatcaattggactaatagtaaacaaaagggactaattgacataatgtagagttagtggtcaaattgtcaatttaatcatctttagatagcaaaattatagatttaaatttttaggagtactaaatcaagtattttactcttaattagtttataattagacaaaaaaataaaatcaaattaagtatcatttttttattattttattagagattaattaaactaattaggattgattaggcctataatatcaaaataggacctgggccaattacacccaggcccaaaattgcacccaaaatactccagccaaaataaaccaacccagtccggacataaaacggcgtcgttttggtcatttttgaccccagccgttggatcatcttgatccaacggcctagaaccccacaactttttaatatttaaatgtccaaacctcaccccactacctcattttcttaaaattccaacaccctcccttccccccaccgtctctctcttctctctcctccaaccatccgccgctgccatcaccgccaagctccgccggccggaaatcgcctccggcggcggagcaactccaaaacaccccaaattttcaccaaacaatcctctccttcccctctatcaccccttaggcttagttttccaaaaaacctcaccaaaattcctagatcttaaatctaagaatcggaaaattttagttccggttaactcactattccacggtccaaatgactcaaaacttgcatgagtcgatagctcttgacaagagctatcgattcatgcgggtttgaactattttcaaacccgccggaatctcgctggaatccggccaagtcgccggaattcaacccatttttcaagctaaccggtaccatcattttccttttccatctcttcaatttttttagagtaaaaccagttttttttaattttttccttattttactaattttattttttattttttttctcgcgttaattagtttctgtttacaaattaattatctccatgcatgtttaattagtttcattgtatttagggtttcttaagtacttaacatgtgaatctaacttggtattaagtacttaattgaataggatttcatgaatgttcttgcgtagttgagtagttaagttttatttatatgtttgttgtttgattattgcatattagttgttagcactaggtttgccgttaagtaactaattagtctaaaaattttggtttaactcttagctaaattagaatagaattaatcttggtctactaagtttgtataacacatttttcaagacaagaattaacctaagtctaaggatttagcttaactaacctaaaggtgattaatctaaaatcaaccttttattagcaataaagtttagctattagttaatcagattagaatgaagttgtttattaactattagtttaacctaacataagactcttctaaaaaacccaatttattttagcttaattaattccttcaaacaattagtttagcttaaccaattttctttaattattcccaagtctaaggctaactaactttacctcttaaagaagattgggtctccaacttcactaagggttagattactttgtaatcatccaaataaataaagttggttaatatcaattgcttagaccaataattagattaattacttggtaagccaagagttagtctaattcttaaagttctaactaattgaattgattaactaattaaggataagaattagttaacctttaataaataacaaccttaatactaaaggagtaattccaaaagtattaaatgttagtttaggaaattcaagtgaggaatcttgggtgtaacaacccaagaagcttctagaattaggataaaaccagaaaataattctggaaaaatcaaaaatcagattttttagggctaaaacagtaattttagaagaggataaaggatgtaaaacaatggaactttatagaatatgtacagctgtcctagctggtacaaaaagatgctgaaaataggataaggacagctgtagttgtactatttttcagattttaagaggataaggtagattcctattggagctgaaatttttcctatataatctaggatattcaactgtcaaaaacagattttctggaccataatttcagatttttactcttcaaatattttcctaaaaatactactcattagaagctgaaatggaggagaaaagagacaaaaaaaaatctatttttctgctctgttttggccctttaaagatggtttttagctgctgaaatttccagatttcctcactgttttttgctatttatcccggggatagctgctgttttttctgctgcgtttaagcttcgggttctcatttctttgacctttatttggtctggttttctttttgctgttctcattcttaaaggtatgtaaaccattctatcataaatgaaattttatttgttgaaataatcatgaatatttgctgaaatttgccatgcatttttgatatgtgtgaatagtttaaggctctttagaaatatataaacatgtcatgttcatcctttttaatttgacttgcattaaggaaacgaatctgaccctataatggtcagattacctcctttaagaatgcataaagctgtctcactttatttcctctttaactggtaaaatgcaggtttcaaaatcatgagccattgaaactgaggcagtttatagtttaaaaaatagtaggattttatgtacaatctttatatggccatgtataattttaattttttgttaaactagctatattcctttcttttcttccattttagctgtaatggactgtataatcgtattaatttcagtagtttacattttcaagtaatttcagcacctaaaactgaaaatcccggctatattagcaaaatttctgttttatattttgctattataaacatatcgatttcaaatttaattgaatgttcttcgcaggaattaaaattttttaatagactatatatcccttgattttggattatgacactaataggctattttgtaaaaatcagcgatttactagttaaaccgggtagatttataaaaaaggtccaacgggcccgagcaagtctacacccaaggtcattaggcctaagggtatgaagcccaaagttttagagttacaaaccgctttaaatttaatataatatggaacacgttaggcaatatgattgttagattgcaaccgagtttaaatatcgttagaattcggcctaatactgttattaattttaaactgtccaaaatttccagatttattttgttttaaatttcgaaatacctgaatacagttttagcatctgtaatgactagatttagcagtttattgtttaaaatttttttctgtttagttgttttaaattttgatccatattttttatttgtatcattaacttagtagtgtagagttaaattgcatgaacttcttctttcacaaatagccaaagtcaagattggcctaaagtgttaatttctaaatgggcttaaattaggccatagcccaaactcttacttatgtttagaataagatcatatatgtctttttatttagaaatattctctaggttggtcttattgatttaatttaggaatttaccttagatatagtaaacgttcaaccttttctttaattaaatagtggatactttaggcttaggaaacaattaacaatcaaagtatacgttcgcgtaactttgaatcaaataactaaaatacaccccttttctcaaattgtgtatacgtttcacgtaacacaaataaagattaaaatgaacactcgtagagacacttttaggaacgattttttttattatcatcggaatcacgtacatgcttgcgtgacgtatttttttttaattgaattaagtgtcatgaattatgtacatgttcgcatgacataatttttggcatatccaatttcaacgggctattcatacgtaactcgcttttgaataattcttcaaatattgaataaaaaaatgtaaaatgcacataggtattaaatcagcaatttaggccaagtttaatcattaagcgaccgtgctagaaccacggaactcgggagtgcctaacaccttctcccgggttaacagaattccttacctggatttctggttcgcagacattttaaacagagtcaaaatttcctcggtttgggattttaataaatgaatggtgtcccggaacaccgtaaaaattcgggtggcgactttgaaaattaaataaattaatcccaaattcgaataatgtcacttcaagtggaaaaactcccttattgcccttaccggtaaaaaaggaggtgtgacaatattaattaagaaaaaggaaaactgagttacgtggagaaatttgcagacaacagattgatgggattgattgtattaaagtggagatcaacgactgagatcaatccaagcgttttgtcatgaatcagcatttttcttgaaaaagcttattcaactatggcctacatatattgcactatattagagagacttctactagcactctctccattcattttatgtgatgcactttgaagaaaaaattgaagggaaatttcggtaaagttatttttatgtgatctgtggatcacgggttcgagtcgtgcaaaacagtaactaatgcttgcgttaagggtgtggtccttctccgagttctgcatgaatgcaagatgttttgtgcaccgggttgccgcactttgactaaaaataaagtttgagaaagaaagaaagaattctgaaattgtggtctgtatgggtcaaaatccgaccgagaaaattcggcatgaagaagtgaccaagtgtgaggatggtggctcatcatggacgactaggttgaggtcgaccaggggttgacagtatggggctgccaagtaagccatcaaagccgaggtcgagcagtaggaaaacgtataacgactagagttttctagagttttttgggagtatctcatataaatagtagaagagatagggcaaaaggcatgtaatattgatcctgataagaactcttgtaaaaggttgactctaggtagacaatacaagaatatcacctttccacaactattcgatttgctatttatctcacattttctcgcataagatccgagataacctcatatattccaatatacatttgtcttacatcattgttagagagaagaatcatacacctcattcaatatttgagtgaatcattctatatatttatatttatttccatttaatatatttattactcatcaatgtcctccattcatttttgatagcatcatttaatactgtttatattaagttggttcaaacgccgttcagcattatttatacaagcacgtgttactagaacttattatttactaggatttagccatcacctttttatttaattagtttaacaaaaggtttcatactttttggtcaaacagtttggcaccgtctctgggaatttttttagtcaaagtcatagtttttctagatctaaaaaaaacaacaacagcatgacacaaaaattcctttttcctacttgcacagtctaacatgtaggtaatgagaggaaagattgaaggagtggcaggccttactgctaacctcctaaacaccatcaatgaggttgatggagcagacaaggagaacatgacaccaaacacttcccctaggagaagtggttctccccttcctcatggcatcgttaccacctcccatggaaaaggagcctctacgtccacaatggaagaagcaccagcagtgaagaaactactagaagtatggctaacgagtacgtgaccagcatactcgacatcacaacaacaaccaataagcagcacgtccctcctccttcaacagagtatcactcacaccgttaatgatgcagataacggtacccttacagctattctaagaaaaatggaggagatggagaccaagagcaaagcgctccgcgaccaaatgagggagcaccaagaaagatagacaagataccaggcgccacaaagctcttaccaaaatagacgttggccggttcgtggaacaacgtacagcacaaggccataccacatgctatacctaaaacattcacgatgccaccatacttgaaaacatatggcggcataacagaccttgaagatcacatcactcactatgtcactgcattaaagggcaacgaccttgcgaaagagcaagtatcatccatattgctgaaaaactttggtgaaaccctaaccgcgggagcgctgacgtggtactcagaactgtcagtgcgttccatagaaatatttaaggaaatggccgaaaagttcgtcaccgcacatgccggggccaagaaagcagatgcgagagtgaatgatatatttgccattaaacaatcacttggcgaaggactcagggacttcctcaccccgattcaaccgtgttagaatgactctcctaaatgtatcagaaggaatggcagtagcagcgttccaaaatgggctgaacatgagcggttcaagggaaaccaaaaaattgttgaatcggctcatgaaatactccccaccacttggatgaaatacacagtacctattgtgtgagggagagcagacgaggacgacctcaatgaactaacccaacgattaacatcgatccagatggagtcaagaaaagatcgtagaaacgataacagaagggatcatgtaggtccacgtctcaaatgtgaaagacaccagccatacgttagaactactgccaatacccccctccccccccggcaatggcgacggtccatccaaagagaacgccaaaggtgaaatggccataaaagatgaagtctgacctaaacaccagaaagtcgacacccttgtatggaaggaggtcataagattatcgcctttaggcaagaggtagtaaacatactccaccaagatttagagctgatgggcgccgaggaagaactaacttcgctcgaggatgagaaaaacatcaaggccccaaagccaccctccccagcctgcaccatccaaatgatcattggaggaggtgacgacgcaacaatcaacaacgtaaagttgacaaccacccacaagttgaaacgattgatcatccatgaacagtatgacgacctcgaagaaagtcatcttcgacgagtcagatacccacggtttgacctttcttcactatgatgctcttgttattactttgtgtatttcagataccgatgtaaaatggattatggtagatgatggaagcggcgtgtgcactatccatccttgagtccttacacaaatgaggctcgaaggtagatagtgccatgctgcatcacactaatgggttttaacaatgcagttgagcggacttcttaagaaatcacactacccgttctggccggtggtatcaccctggaaataacgttccagattatggatcaagatacggcgtacaatgccatcatatgacggccttggatacacgctatataggccatcccatccagcttatatcaggttgtcaagtttcccaccctctggggagtattcagcatctgcggtgagcagcacatagcccaagaatgctatcgcattgcccaagactgcacatacacccaacagttgaaaggcaaagacgcagaagcataacaatttagcgaggtcgaggacggatgacgatgaagggaaagatttcatcaaggaccccgaattcgtggaggctacgggatcaactgtggaagacatcgaccccgtttagctcgataagaacgaccacaacaaaaaggcttatatcggccacaaactccaagaaccaggtaaattccatcaatttttaactaacagtgcggacttgtttgccttttctcatgcagatatgccgggaatcttgaagaaaatagcaaaacacaaattgaatgtcaacccactctaccccccggtatggcaggttagaagaaaattcaatattgcaataaatgatgtcatccacgaagaggtggaaaaattacttgaaaaggatccatcagggagttaaaatacccacaatgggtcgccaacgtggtcatggtgaaaaagaaaaatgggaaatggaaaagtgcgtagacttcacagatctgaacaaggcatgcccaaaagactcattcccactgccacacattgatcagctcattgatgcaacagcaggacacgaactgttaagtttcatggacgcctattcgggttacaaccagatcctcatagagaaggaagactaggaaaaagctactttcattacccaccaaggtacgtactactacaaagttatgctgttcggattgaaaaacgcatgggcgacatatctgaggatagtaaccaaaattttcaaggaacagctcagcaaaaccatggaagtatatatagatgacatgttggtcaagtcgaaaagaaaggaagaccatatcgaccatttaagagaagccttcgacatactcaggcggtacgacatgaaattaaaccccgagaaatgcgccttcgacgtaacctcaggaaagttcctctgctttttagtgtcataaagaggcatcgaggttaaccccgaccaaatcaaggctatagagggaataccggataacttaatcagcaagaaacaagtgtagaagctggccggctttatagccaccctatcgaggttcatctcatgatcctctgttagatgccacaaattcttccccttgctaaaaaaggacaacaaactccaatggaattctgagtgcgccgacgccctaagagaattaaaggcgtacttatcttcgccctcgctatttgctaaggcagaacccggagaacacctcctcatctacctagccgtgtccgacgttgcagtaagcatagacctggtccaagaaaataagggtatgcaatctccaatctactaaattaacaagaccttggtcgacgatgaaacaaggtacccccacctcgaaaatctagccttggctttagttgtagcttcacgaaagcttagaccttatttccagtgccacccctgccaccccatctcgatggtcacaacttttcctctaaggagtatcctatacaagcccgagctgttgggtaggttgcccaaatgggccattgaattgagcgagcacggtataacctatcaaccgcgagcaacgataaagccgcaagtacttgcctacttcgtcgccgactttagcgctaaagtaatgcctgaggtcgaaagggaagccactgtacttccccaagacacacgccctatggattttgcacaccgatggcgcctccaatgcgtcaggatttggattgggactcgtacttgaggtctcgacatgtgagataattcgctagtacatacggtgtcctgatatgactaacaatgaggccgtgattgcagggttaaaaatggcactcaagtatggagaacgacgggtagtccttcgattcgactcataactcatcgtcaatcaagtaacaaggactttccaaatcaaagagcaaaggctacaaaaaatcaggccgagatctacaagttactgcccgagttcgacgaataccagctcagccaaatacctcaaacgcagaacatcgagggggacggcctcgccaaatcagcgacaaccaccaaagcataaccgaaaaagagaatgtggtcactctcctccactcgaccatcaaccaaattgaggtatgcactattaacctaacttgggattggcgcaaccgtattgttgcttacctgctggacggcgtgctcccaaacgacaaaaaaagagccaaaaagcttcgaatgcaagcaaccaggtataacatcatcaacaacgatctatacaaaaggacctatggcggccctctagcaaaagtttgggaccaaaccagatacgactcgtcctggaagaggtccacgagggtcactgcggggctcacaccgaaaattgagccctagtcagatgtctcatacgagcaggctattactagcccacaatgaaaaaagaagcagctgattttgttaaaagatgtgaaccatgcccaaagtacgcccccatgatccacccaacgggcgagcactcctctcagtcatccgccttggccttcatcaaatgggaggatatcgtcggcccccttccggaggacgaggtaatgtacgatttcttttggttttaaccgactatttttctaaatggaagcaggtgcgttcacccaaatacgcaaacaagaagtgattgccttatatagaggaacatcgtataccgcttcggaatccccaaagaaattagttgtgacaacgaacaccaattaacaaggaagaaggtcgctgagttcttcgagaaatggcacatcaaaagaatactctctacaccatatcaacgaggcaacgacaagctaatcctctaacaaaacgatattgaatatcatgaaaaagaaatgaaatcgaaatgtcaagggactgtggccagaaggtgcttccagaagtgttgtggcgtcccgcccatgccaaagacaagcacaggggaaacgcatattacactagtctatgggctgatgtagtgataccggtcgaggagagaaccaagttgatattcaaatgagagcagcagcaacgataaaatcagaaggcaagacctcgacgaggtcgaagaacgaagagacatggcttacataagaatggtagccataaaaaaatagtagatcggtgccataaacaaaaaagccaaggtcaggtcatcaaagtcgtggatactgtactcaaggccaaaacacaggcgaccaaggatctacaagaaggtaaaatgggaccattgggacggcccatacaaatatcgtgcagtaagcaaagggtcgttcctgaagcataagagggggagggggttgaattgtagccttttaaatttctagtcaactactcttcagacctagtcgacttatgcggaaacagccctacaccaaaattgttagtacttcaatttaaatagatactactcacaataaacagtaagatgtataataaatgacaccaggaattttatactggttcggaaccaatgtgatatcctaatccagtctccttaggttgcaaggatttatctcttgagctctttgtaatttgtattaagtacagcttgtgtgattttcaaaattcaccaccaacgtttacaggtttggttttcactcgctcaccaacaacgaccctttggttttcactcgctcatcaaaaaaacaaacaatgacacaacctctccggacacaccgcctctccaatatttttctgtctctcttctctcttttgtgtatacagtaaatctactaaagtgaattacaatgcttgttaagagtagaataaagaacttgtagttggatagacaattatatagaaggctgtgtgctttcttcctttgtagatctccttttcatagcctttcaacatcttctggctaatgcataacccaagaatatttagaaatgattctcttgatcattgtgaatgggtcttcaagaatatttgttttcctttcttgattgaatccttccttggttgctgatagtagtctttgtcaattgatactccatattttgtcttgatcatgtccttttctaattttatttgcttccataaattgccatgacatgtcatttgaactaggacactttgtatttcttgccttctgagtgtgagtccatgacaccgctactttcttgtaattgctcacaaaatctttcttaactgattttgtggagtacatattgatgcctttatttccttgtggacaatttgacattggaacttcctttgttacatagtttccttttgaataggtactgatcatatctttgtagctacacatatgcaccctctaatattctttttgtagtgctccttccgtagaacacctctttccttttcttaatagacttccttgattggtgtaaaagatttgctccttaaaataaaccatgctatcttcttccaataaaatatttcctttttgatagatctcaatatatctttgaatcctttcttgatcttgaaaaataatctctttctacaataaagaatatactatactcataatatattttctttccataagaaatatattcttccttgccttgtaatatctcttccatatagtatctttccaccacaaaataatagatcttctccatgattttagcaactttcctttcacgatgttgaagagctttccatccatagtttccatagattgttcttttgatattgtaataagccattcaatatttaaaatttcactttcaaatattattccttctttgacgcttggagattaaatttctgaaaataatcttccttaataaattcttcacatgatattctctttcccatatttgcttggatctttaccagcattttctttccggtataaaaataagattaccacaagtaaatactctttgattagtatttatgttagtagtttgttatcatcaaaactaatacgtgaaaccttgaagctaacaattccaactagaaacaacggagggaaaattactaccaaacaattggaacgtcgcccacctcaaatacttcaacttctaaggatagacgtcctccaggtcgtactctttttacatcatccgagttttgtcccaattggattttctcgaggaggtttataacgaggccaacgaagagggcttctcgaagttaagtataagttcatcgctcgacctctcaactacttttccaggtcgaccaatgaagggactagatagactgagacttctccaatgtatgtatgaacatagcaaaaacatgtaaacttatccaataatgtataaacaaagcgaaatatgcaaacacatgatgttcacatgtctccaccaagtttacacattaagctaatccatggaacaacattcgacctcgttcgaatcaattttaaagtcaacattcgaccttgctcgaatcgacttacattcgaccttactcgaatcgacttacatccgacctcgttcgaatcaattttaaagtcaacattcgaccttgctcgaatcgacttacatttgaactcgttcgaatcatttttaaattcaacattcgaccttgctcgaatcaacttacattcaaccttgttcaagtcaattttaaagtcaacattcgaccttgctcgaatcgacccatattcaacctcatttgaattaatttaaaagtcgacattcgacctcgctgaatcgactcatattcgacctcgttcgaattagctgaaaagtcgacattcgacctcgttagaatcgactcatattcgacctcgatcaaactaattacaagccaacattccaccccgttcgaatcgactcatatttgaccttgctcgaattaattaagacacttgcatacgacttggctcgaactaattaagaaacaattcctcgaattgcaatcaaagcagtcaattgaggaaaacattcgaaggaaaaatgagaaactcagaaacggacatcaaaagtatcattccaaaaggtatcttaaaagggccaaacaaatgcccgcaaaacagaaaaggaaaaaagaacaacaaaattacaaaacaagtacactactcggtagcatcacccccatcgccatcatcaccagcaccctcgtcgttggagtattaatcatcataccaagcacctggctcgagcccgtctaaatcatctttaccatcaccctcccgggcgtaccgggatcgtagccataagcgtcccgagctgcacgtgtcttaacacgagcatcctcaaattctgcctcagtagctttcctggccgtcatcaagcccctgaatatgtctaggctagcctcaacatgaatccacttcccgtacaaatcccatggaacatcaaggtaagtggaaacatgggaggaagacggttgagccaatagctgcgccttctcggtcttgaggacggcaatatgctcgttcaagtctgaaactttgtctctaggccaccaatccgttcttcaagcttgcttccttaagcgcatacatctccactttatttgcccgctcagatctgaggacacggatggaacccgctaatgccaccgcctttgccacaaccgtcgtcctggttttctcggctctctccaactttgtagcttttatggccaactcgtcactcaagcctttggctttagctttactctgctcaagctcggcctgcaaggatgccatctaagcctgaaggtcgacgtactcggccacaacccctttgcttacctcaagctcgtcctccttgactctcaacgttctttcaagctcgctacatctattgatgactctcatgagctcatcatccttctgcttcaggtcatcatccttctgcttcaactcgtcccggagagactggaactgactatcctctccgagtatgctactcaatgtgcgatgcttggtacgatactccctatacttggactctattcttttatagagagccttcctcttctcttctcgatgggcgcactcaatctcatgaatgagagtctgataaacaggtagaaaatagtcaaagacgaacaaggtaaggaaaaggaaaagataggagaacacaaaaatgacaaaaaacttactcgcagggccatcctggagatgcctaacgaaaggtcggcatccttaagtgtctacaaggtcctattctcagagcccatgcagaggggaatcaaagttgggaccatgctctccgagttagttaacaaattatagtccaagggaatgacgatgtttcggatagatccctccgttctcacctctacccgactgaacccctcgtcaaacatctgcacctcctcagggtctatgtcagaaccagacccatcatcgtccacaaccacattctttccttttccctcggtggatgacgacacgacctccgctacctctgatcgcccttcttctatggcgacctctaccgcctctgaccgtctcccttccatggcaacctctagcgggagaatagtctctacaattgaaggatgtgtagactccacgctcacaacaacatcactctcaggtgcggccacggccgtaaccacttcgtcaacctccactctccgcctttttagcaaagcaacttcctcatcacccagtgaagactcgtctactagacgtaatatcgggaaggctggagtctccactggtggagcaccgcccgatgactgggcctactcaaagtcgaagtctgagaggaagtattccgcacggactcggttaacacaaattgcgacccagtcgaggcacccgcttggcgaaatgcgggaacgggagcctttgccttttttggagctcttcgacctgacaccaaaagggaaattgtaagtaaaaaaaagagaaggtgactgtaatgaggtcgaagtagttaaagaacgaaatctgacttaccagtcgaaggcttgggtccaaatttcgtgttgaaagacgcccaatcatggatccctactgtgtgggacaagacttgggccacccagtcacaaatatcaacgaccaacaaaggaggatgtttctcagctaaacggaaagaaaagagaacgatcaagccacaaaacaggaaaaaaaggaaggaaagtacttcaatcaacaaaagcacttatgggcgaagttccactactcaggaaatccactagcgctcgccaccatgtgcttgtttttttaaaaaaagaagttgaacaaaaactgacgattctccttattgtccattctcgccactagccccttagtccgcggtggagaagatgaatcatcgtgcccctatggaagcttggcgcgaagaggcgcaacaaatggcggatagaaatttcacagtcggccagctatgcaaactttgtcagcataaggaaaagcttgtaaatgtaggggagagttggaccgggaagacgccgtagtaaaggcagaattcctccgccaacagaggaagaaggagagagtaacccacttggaacgggtatgcgtaaaacgtacaatacccgggacgatgaacctggatcatgtcgtccctagctggaccaggtcaacatgagcagggatgttgtatttggccctgggtgtggctatatgggttgcctccatctccgacttcacgggctcggggtcatgcacatgtaacttcgaaaaatccgacctggagcctgggttacatggaacgatttcttccacggtagggaagctttcatcatccataactatggctcccctccgtcagaaggcatggccactgacagcggagttgggtatgaggtaatctcagggttaggagttatgccaatcatcttctgctaatatatcttacgatggaactgaaagtgtagaagaaatggtgatatggacacaggaagaaggagaaaaaatgatgagcaagattgaaaaatcagagagagtaaagttttctacaaaaggcccccctccttatttatagaaaaccatgacgctcaaatcgatacaaacaaccgccaaacaacactagaatcgaaacgacaaggactcaaggaacaatgcaacgcatcgggaagatgtgtaataatgacacatgcagttgtgacgtcaccctgaacctgcctcattgactgcagctctcggagcgacacgtcatcacctcggcagcgatcaccacaacctgacctccacgtccgaatttctcaagaattgcgattaataaagtccgctcattgaggtcgaccaaaagatgaccgcgataagcggaggaactaattgtatgggtcaaaatccgaccagaaaaattcggcatgaagaagtgaccaagtgcgaggacgatggctcatcatgggcgactaggtcgagttcgaccaggggttgacattatggggccgccaagtaagccatcaaaaccgaggtcgagcagtaggaaaacgtataacggctagagttttctagagtttttggggagtatctcatataaatagtagaagagatagggcaaaagacatgtaataatgatcctgataagaactcttgtaaaaagttgactctaggcagacaatacaagaatatcacctttccacaaggattcaatttgctatttatcttaccttttctcacatcaaatccgagataacctcatatattccaatatccatttgtcttacatcattgtcaaagagaagaatcatccacttcattcaatatattacatttatttgccatttaatatatttattgctcatcattgtccctccattcatttttgatagcatcatttaatactgtttgtattaaggtggttcaaacgctattcgacattatttatacaagcacgtgttagatctagaacttattatatttaactaggatttacccatcacatttttatttaattagtttaacaaaaggtttcatactttttggtcaaacatagtctaaaacaagttctatatacttgtatgttatcaatcatttgattaaagataaaatgagaagtttaaaattaaatattatataaatataaaaaaatatcactcttttgagacatactaaaaatgaaagtttttcacataaattagaacataaggaataattatttggaaaaaccacttgtatatactagtgctactccctctcccctcccccaatgcatgaggtattaattcactaatcgagaatcacatcgcgtaaaacgcactaaaggagaaatgcttcctacgagatttttttattcaagtgctcaaatttacaacttctaattaaagacagagagattcaatcccttccacactgatgttattggttaagaacaacaataatgacttattgtcaagtgtattgtattaaaaaaattaaaatattcaatttagaatctttaaaatcgttgttataaaattcaaaactcatcaaaattgaaatcgttacgccacctccacttatataatctatttgtgcaccgacaaagaaaagctacattcatgactgtcattgcggttcaacaaacaccaagaaatagtaatggtctatttccatgtaatgtatttttgatgttttgtacgttttattgccacaaatatatagttaaaaaagagacaagcaagactcgtgattacgtagcggatcaggccgataattatgcttaatggtttggcttatcggttgtcggattgtaaatatagtattccgctagtcatccaataagataaggatggattggtatcggattaaagattatcgagaaatttatcgaataaatcaaataattttttattgaacaatactagttatgaataccaaacggccaaatctgataaagtgactcgactataagttccatcccctttttagtttactaggcttataaacatctgttgttaacactttgtagcttgtactgcacttgctataagtatttcttttggttgcatagctatcatgtttcatatcaaaaaaagaaaaagatggaaaactggtcagactagctgaaaacttatatacaatcggaatgtactacacccacaaaacttgacttaaaacttgaaggcatttcaggtttattttctgataatactcctgtaacttctgtggacccatataaaagtgtaaatataaaaatttataacgggttaacgatttatccgataagaaaatcgagtgatccggccccaaactgttaagccgttaattataaaatctcaatccgtttaccaaccattatcccgataacctgataccgataaaccaataggccatcggttcgattcggttaacggttacaattcgattttgaaccgccatattcgatagcaataaaaaagaaacttataacagtcattttttttggtttcccacctgatgcccgatacccgcattaaagtatatccggattcgcatcgcatagggcccattcgaagggaagtgctcataacaattaatcctttttaaaagaaaatgtttcttgcatatagaatgggagaacactggataaacagtgcaattaactaattctgattactattaattatcatcaaattagttccactgaactacagctgcagaataaacagtgcattggttctagtaattagtatatataattagataaataataatatgtaaatacaatgcagaaacaaaaaattgcgagcaatagataaatatatctacaacgtagtaatacttcaccatctgcatgcctatatatcggtttaactaaataaagacctacatcttatattttaaacaattcggtccaggggcgaagctatgttgatcaccttcgccgaaaaattataatatgtttaaggtaaaatattatttgttattgacgtaaaatagtctttgaacacctttgcatgactcgcccactgacaaaaagtgttttattgaatttcctgacttcgcaactgcttgacacgattgagatactttatcttaaagtaaggatcggagattgatttatcccaaaattttgaaacacatctaaaacgaagaagagatcgcacgggtaacctgattaggatgtctttaaatatttcctcttggaagtaaatttccatggcctacaaacataggataaggcaactgctttagtagtttacaggctaaaggcattagtctttcgcgctcgcgcgcgcatatatatatatatatatatatatatatatatatatatatatatatattagagagtgaaatcataactcgcctgatgattattggttcaaacctattatttattattacaacaaaacaacaacccagtaaaatctcacgagtgaggtctggggaaggtactgttgaccttacccctaccctaacatgatagagaggctatttttgatagattcttggctcaagaagacgaaaagacgacgaaaagagataatatatccataccatcaacagaaaccataataacaagacttattatttgttactagcttaataaatttttacatataaatttatattccgtgtcgaaaataccagatttagatgaatccggtgttatactaagaggttatatgaatttggctcataagaaaaaaacagaacacgcacgcacacagcagcagcagcacaaaggaagagggcatacctttgcacatttgatgggtgagatgagaacagactacatgaaatatagagggtagtcatcagctaaataggattttgggctaggcaatttaacgggttgggcttgggtaactaggctttgttttggaatttatcgaagggaaaaggccaaatatatctatctactttcatatattgactatatttaatcgcagttatactatttggccaaatttatccctaccgttatattattcggccaaatttatccataccgttatactatccggccaaatttacctctacaatcagcaaacttttaaaaattacccctcagtccatcaagttacccagaatctcgcaatcattttaattaagtcactgattctttttcttggtccactattatttttgaaataattgacatttacctgctttctgaattggaaaaaaagaagagaaaatattaaataatacaaccgttacaaaacaaagtataataaattgaagaatctaaattaggtagcttgtctaaattcaaaaagtatttgcaatatcctaattttaatgaattcattgcaccaaatatatggagactttacaagtatttgtgattgaagttgaagttactcggagattttatattgttgaattgaactttgctttactcaaatgcctacacattgtgcactcttaaattagttgatcgaaccctatactaaccagacaatgacaaaatatatttgaatatacatgtacatacataataatcagctgcatataatacacaataaattgaccctctgaattctacggtgtgtgtatggttgaaaaataaataaaattttaaaccaattccaaacccattattaccagaagaaaagtgggtgcattggtaattaaaaatattcatgaataatttgtatagtctagtaactttagcattcacattaatagtaatttctgaaaatagtggagtaggaagagcaataagtgctttaaataaaaggaatttagaagattttggattatttaacaggtcaaggggtaatttttaaattgttgctgatgataggggtaaatttagccagatagtataacggtcgggttaaatttgcctgatagtataacaaaagttaaatatagacaatgttcgaaaatagaatggtatatttgactcttttccctttgattaataatatttttatttctctggcaactaatgaaccttttagaccacaatctaaagatttttttttttgagcaaactaaaatactttatgaaaaatattagaccatagcctaatattttgtgagaaaattaaatttatacgaacaaacattagacagaagtctaacgttgtatggaagggctagttttccagatgctatatttgcacaactttttaaggacaaaatctaaatagtagtataagaaagggacatttgtataaatcagcatattttaatacaaatgccacaataactaaaataataattaaataaaataagataaatgcacaaatacagacaatcacaattcaagatgaaattataacgaacacacagcttatatagtgctctatgaatgaaataaaattgttgtggtccgtttttaaaccaaacagaagcctgtgaaaataaaattatggtaaagtattgacaaaatcggatgtcaacaaatgatattttcttagtattcaccaccacgcttgatccagcttatcttaatggtcttcccaaatatgattttgtttaaaggataatcagctttcgtatgacctacttgtttgtaatcccaacacttaatatttttataagtaccgagttgatttagtggagcctgggacaatttttacgtatattttagtagtatctaaatatgggatgacttttttggctctttaatatcgatacatcactatatttcttttatgtatgagttttgatgctaatcttgatagtaaggtgtgaaggcggttgaagaaggcctcatatggaagcaactgatgctttgattattcaattgactgctcgtctttatggggcccttgtttccaccagtgttactaattgaaccatctgatagaaaaatatcttatgcaaacaaaacttcctcctccaaacaattcccagaaccccaaatcaacatgtaagagaatctgtcattgcaacacacaccaatcacaatggaatgccgacagttttcttcaaggcgtcagattactatggcatcatggcagatgagtgtaagctcacaattgttggaagattcctcaagcctaggccccaaattgaccaaattaggtcaatttttaaagaattaatttctatcaaaggctcgatcaaaattggggtttatgataactacaatgtcttcttagatttcaccaacgaagacaatttcaatttatcggtacaagagggttattgaaatttagggacaacaaatgtggctacaaaggtggtcgttgtacttcaagcctgaagaagatcttccagtggcaccggtatggatactactaccaggactcccctttcatatgcacacatgacagtacgttaaacaggcggtcaacgctgttgcgactccactggaaatggacctggcaacgagaggaaagaccagacctagcatggctaaggtaagaattgaaattgaccttctaaaacaacaactagattcggtccatgttggtcaagtctatgataatgcccctaaaaaaggttttgttcaaaaacttgaatatgatggggtttcaaaatattgtaaacactgtaggaagcttgggcataatatgatgaattgtagagttttggaaagaaaaatggaactggaaaagaaagaacaagaagcaaaacaggacaaggaagggaacattgaaacttaaaaaaatgaggaaaaaactgataacaaagaagcaaaaataagggaagtcagtagaataaatttggaattgcattctcaaaggaaacagggacacggtatagagcagaacaacaaaaaagagagcagaaaaaaaatcagcaaggaagaacaaccaaccgatgagaacaaagtggaaagttaggaaaggatgcaaagcatcaagggaagaacgaccaaaaaactcaaagttagaagacaaaagagagtttctaaaaagaagtccaaggtgacatttaaagatgtcaacatatctagtaactccaaaaacaagggagttataatagctgctatgaatgaccaacaagaaaataactctcaaatgaatactcagatggacaccaacagaagtgaggataagatacaaaatggagataaagaagcactaatgtgaccaagaataaaagttaaaatgaaaatgaagaagcagtgcaagaatcaagcaatattgagatcataaaatcaggcaaggctcctgactggcagatatatatcaatgaatccactagtgtcccttcagacatcaagaatctactaggaattttcctggcagtcaatttgatccctgaagaacaggaagcccacacagaggcaacctcaatgaggagaggaactcaacaacaatttgaagtaacttccccaacagagtcactgttgtgattccagaagatcaattaaatactgtgcatgacaaagaggaagggatggtttctcacctgtcaccaaacgcataaaccaaaacaaaaagaaagccatgattagtggaatcttctggaacattagaggagtgaactgcaagaaagccatgcctaggcttaaaaaacttgtcaacaacaacaaagtggatttcatagctactatggaaccgtttgccagcatgaacaagattgataaatacatgaggtatctcaagtttcgacactgcatctccaacaccaattggcaaatctggctcatatggtcaggtaattatcaaacaagtgtgattagtgcaaatgaccaacaaatcactatcaaaatgcagaatgggtgagtactactaatatgttcatcactgttgtctatgctaaatgcaacaaaagtgaaagaaaaaatctttggagtagtttagaggatactcacatgttgattgatgggccatggtgcattggaggagatttcaatgttattcttgatctagatgagaaataggggggtcgtccacacagaatgtacaaaagtctaaattttagctcttgtatgaacaattgtaaagttaaggatttgggctatgttggacctaaattcatttggtgtaataattagggtctagaagaagaatttggaagagactggatagaatttttgtaaatgatttatggtgccaactccttcaaaataacaatttcaagcacctttcgaggactggatcagaccatagaccattgctgcttagttgttataacaggaacaatgatggcataaagtacttcagatttcttgacttctggaccgagcaaccttccttcatgaacctggttgaagaagtgtgagttactaacatacgtgggaatgctttgaaaacttcaacagaaactaaagatgatcagcaaaagacttactcagtggtctaaagaagaagttggcaatgttttcgatcatgttcaacactgggaggccagaatgcaataccttgaggagttcgatttaaataacaacactggtttctctaaagaaaaactgaacaaagggcaagcagaatacattagatggatgactatgcaagatgctatcttgagacagaaagttaatatcaagtggtttgaagaaggtgactacaataccaagtactttcacaacctaattagagaaagaagaagaaaatacaagtccacaggatcaaagatcatagagacagatgggtggaaggtgatgataacatagcaaaagctaccattcgacacttccataagagattcaacatcaataaccaattcagagaaatttaaattcttgaatgcatccctcaaagaatcacaaatgaggacaatagaacttccactgccattcctaatactggtgaaatcagagatgctgtctttgatatgggagctacaagtgcagcagggccctgatggtttcaatggcacctttttctataaatactgggtattatcaaaaatgatattactgatttgttcaagaggttttcaatgggaataggctgtccaaatttttttcacatacctgccttgtcctgcttcctaaagtggagtctcctaacaatttttctgagcttaaacctatcagtctaggcaatttcactgccaagatcatctccaaaatcctttcaagaagacttaaccctatgcttcataagttcatctcagagaatcaaagtggttttttccactacaaaaaaattgaattagctacgaacgtcatcgctaatctgttgctaaaacgctcgtagctagcagaatttcttgctaatccgtcgctaaatgagattagcgatggaattttttgtttagctacaaaatttgtccgtcgctaaaaacctgattttttagtagtgttcaaaggaagatctatcactgaaaatattctacttgtgcaagagatcactcagaatatcaaccacatgaattatggtggtaatgttattatcgagcttagatatggagaagcctacgacagaattcagttatgaggaaatatgatttctccgaagaatagattgacatcattggggtttgttcaacaatgtctgtattctattattatcaatggtaattgaaaaggtttctttacttcttcccatggtttgaagcaaggggatccattgtccctatccttgttcatcattggtgctgaagtgttgtccatattttgaataaactatttgaatatgacaacttcacttcattcaacatgaataatagaggacccaacatcaaccacttatccaatgacattgtcatattctgggaggaaataagcagccatcaagcttatcaagaatcaaattaagagtatgaaaaaccccaggacaaaaagtcaaatgacaagagttacttcattacatctcccaacacctctgcctccaggatcaatagaattagacaagcttctggtttcatggataaaacgtatcctttcaattatttgggatgccctatctaccatgggaggaagaacactgtcctatttgagggcatgttagctaaaattgtcaaaaggcttgatggatggcaaggcaagattctatcatcaggtgaaaaaatcactctggtcaagcatgttctacaatcgcttcccacttatattctgtcagctatgaaccccccctcccctcccaagggtactgttacccttatggaaaaatattttgcgaatttcttctagggatctacaaatgttgagaacaaataccattggagctcttggcacaataagtgccttcccaaatatgaaggtggcattagtataaggaatagcaagatgtgattgaaacctttagtatcaaagagatggaagggtttagaacggaacgttctttatgagccacctttctcaaagccaagtattgtaagagacctcatcccatgagtaaagtccttaacccatcagattctcgcagttggaaaaatctttgaagaccaggagtaaagccaaaatgcacattaactgaaaaattcaaaatggttcattctgcttctagtgggataattggactggtaaaggacctctagctcacctgtatcaaggtactaggaaatctgcaaaaactcaagtaaatggcttatttcacaatgggcaatgggacatcaacaggttaaaccgagttcttccttctcatattactaattgcattaataaaattgatataggtaatgatatggaagatgacttccctgtttggaattcttctgatgatggtctgttttcaaacaaatcggcttggcacctaattagatcagaaaagaaaaaaaaatgatttcttaaagaaagtttggcatcattctaccccttctaaaatgtccttcctaacttggagacttcttaaaaggaaaactcccgtttgatgatatgattggtagctttggtactaacatcgcttctagatgctcttgctgtagtgtcccacaggttgagactatgcaacatgtgttcgtgaaaagtgaggcagctatgttcatttggaaggcaatgggcaacccctgggaactgggcatcaacacgcccctgttcctgtcatcttcaaaaactggtgggaaggataagcaaagaacagagttcatggcttgattctccaagtagcaccaattgtcatatgttggaagatttggaaacagagaagctcttgtagatatggcacgaagaaaaaatttcatctcaacttcatgaaacatcaagttatatggactatcaaatccataatctccaaattaatgccgaatggagacgtctatcaacactgacctaacttatgcagcaggatagagaagttgagacatgttcaaacttggaagcaagttcaatggcatcctcatctatatgacactatcaaagttaacactgatggtagttacatataggaaagcgggaaagctggcataggagggataatcagagatgagaatggtaactgtatcatgacctttgctacgcctgttaattgtgatagcaacaacatggccgaagccttagctgcaaagtttggagggaaatatggtgcaaccaattaggtttatctaattttgctctcgaactagacttaactgtcatggttaacatgatcaaccaaagaggaacaaagaacatgaaactaaagatggtggtggaaaggcttataaaagttgccaaaatgcaaattcgactgttcaacactgctacagagagggcaaccaagtagtcgatgccttagctaaactagcctccacctccaatacaaggttgatctgccactctttcggtcagctaccaaaggaagctaaaggccccttcattctggataaataataaatgcctagtattagaacaaaatatgataactgcaacttttttgttagttgattatgtatatatatacactggcagtagagagggtttgtatacctcctactgtattttgggtgatagaaatcaccatgttgtattacgttattgaggtaaggtcaagtgcccctcactgtagattttttgaaatacaacacactcagacctctgtctgaggtacttcatataaaaaaaagtaagttattttccaatgtttggctgatgagaaaaacatttaccggtaacaaaaatagtttaaagtgcccccctaaagactagatataacttgtgcttgagttgcattctcatgttaaaaccaaaattaggaacctgccatcattgaactgaatgttgtatatatttaaagacatctaatgtttaagacctcctgctttcatggagatatcttctctgaccaccgaaaattacccatatatgaataaataatcgtgaagttcgacaattttttgaggaggagattgattgattgacaacgaactaacagaaggggaaaagaggagtgaaaccattcgacggacccggtccaattctttcgtagtcgtagcttattggcctgtaaatcatgttaaccagttaagcagtggtagctctgaagtagatcataaatcattaaaaacttctctatattatactttaaaggtttgtcagaaactgcattcttcatccacatcagtttagccatttataataatccaaacctataaacaaacataaatcagtcaaatacagaataggatatgtataattggcaatgtaaacacaagctcgattagaacaaagagttaaataacaacatttcaataatgtcaagtataaaattatgcaaattactcgagctaaattatcgttcaatgttgataagcataagcggctgattccacgatcacaactcataaagcaaagtacaatgaacgttaaaatgaatccattgcatgctttttgcttgaccaaaaaaacaaagaaaaaaaagcaatccggtgcacgaagcatcccgcgttcatgcagggtacagggaaggacccaagggtgtgatgtaagcactctaccttgaagcaagtaacggtgattgattccatgacttgaacccgtgacctacaggacacacagagataactttaccgtgcttttggcttgaccggtagataaatataaaaaacaagatttacaatatatacatactaaaaaatcacactcattctgaatctgccgactctatcctacatagtaaaaaggatgacataaagagcacattgttggttctcctctgctcaaaatatgattcatgtaggatctcataataagaaaacaaagcaatatataataaattaaagctgtggagaacttatcttataaaaaaataatagggaggaaagtaaaatacttacagattagatatcagagttgaacagattgatctcaaagagaactttaatttcctgatcaaagagctttaagagaaggcaaaaagtattcaacaacaaaagtgaatttatacttaaaaggaataaaggatggtgattgcgtaccttatatattacaacaacgacgacgacccagtatagtcccacaagtggagtccggggagagtagtgtgtacgcagaccttatctctacctgatggaatatagaggctatttccgatagaccctcaactcaaggagacgaaaagacaaaaggagacaatatatcagtaccatcacggacgtaccttatatattgtgaaataaaatacaacaggaatattcatacttactatatcataaaatgacaacgcagaaagtttttgacacataatttatctctcctgaaactggaaatatatgagacaaagggagcagaacacagtcctgaaagagcaagatagagtgacaaaacatgaaagtttaaaacacaatagagaagaaaaaataacaacaaaaaacccactgtaattctacaagtgtggtttgaaaaagaaactgtgcacgcagccttaccctaccttgtaaaggtagatagactgtttccgatagacactcggctcacaaaaagcatagagataatcaatttctacctaaaacaaaagattcaccaaaacttctcatactttcaccaaattattgggattttatttgaaatcactgtcaaaggataatagcattctataccgataagaaatgcatactgggcttaactcaaccctcaaagtctcatttcctccaccaatgtaagctattttacatctggaacgtggataacatagcatagaaactcaacgccgataaacccaaaaagtaggaatgagtctaactgtggcacgggttggctcaaccaaaccaaagatacttttaaaacggtgtaatattgtccgctccaggccaagttcatatattttcccgcaaggccttactgaaacctcacaccattaaaggcatccctacgtattatacgtaggtacatactaatcttctctgccaccaatatgagactttgttcgtacgcccaaccgatactataataacaaacgaacattaagtctaacataactccaacactataaaagaagataacaactcatttcctccaccaacgtgggatacttaacacacaatctcggattgtgattggaatcctctatccttgaactgagttcatatattgaatcaattaaacgcataaatcaattaagtgctcaaaacaataccaaataaattgaagtactaattagaatgccaaagaaaaagatgcatagctcatgactaaatttatgaaattagcaataatccaataccaatttcagctttaaatagtttgatacatagatacattgatcagccacttgacaatctaaaaatgaatcaacataataatttttgtgtggttgaaatacttgagtatgtgggagcctcaatgttaaagtagaagatagtgacttccaaattcctacagaccacaaccttttacatgtaataataatatttctaaatttttatcacacaacagttagatgtcaaacttttaatggaaaatgaagtgttttttttttctttttctttttctttctgataaatttaacacatcatatttgataaacaggcaacagaaagaaacagcaatactgactgcacaagcggatccaacatataaattttaaatttgttcgacctttaggtttttgatattgaatccattacacttttacaatcagggttcggaatttaatttttgttgaaagtttagtgattttttacgaatatatctatgctatttgtcaaaacattgaactcagttaaatccattgattatatgctatatacgcctctgaactaagttctagtctagggtaccaaacaagtttgaaagagagtgaattataggatcttggatcctttcaattaaaagagggaaacagtatattggcaagaaacaacaacaaaaacaacggcccagtttattctcacaagtggggtgtggggagagtgagaagtacgcactcctattctgaacgggcagagaaactgtttccga

The invention claimed is:

1. A TMV-resistant tobacco plant comprising a short N introgressed segment, wherein a drag genomic component with the sequence as set forth in SEQ ID No. 13 is deleted or a drag genomic component comprising nucleotides located at positions of 120,988 to 806,914 as set forth in SEQ ID NO: 13 is deleted, compared to an N introgressed segment of Coker 176 type tobacco accessions.

2. The TMV-resistant tobacco plant comprising a short N introgressed segment according to claim 1, wherein the plant is
   a tobacco plant that is detected as positive for N1N2 marker and negative for TN4.99 primer pair, TN5.20 primer pair, TN5.34 primer pair and TN5.51 primer pair.

3. The TMV-resistant tobacco plant comprising a short N introgressed segment according to claim 1, wherein the short N introgressed segment is obtained by means of chromosome crossover, genome editing, chemical mutagenesis or physical mutagenesis.

4. The TMV-resistant tobacco plant comprising a short N introgressed segment according to claim 1, wherein the plant is derived from *Nicotiana* genus.

5. A tobacco hybrid, a variety or a line bred from the TMV-resistant tobacco plant comprising a short N introgressed segment according to claim 1.

6. A seed, a pollen and an ovule of the TMV-resistant tobacco plant comprising a short N introgressed segment according to claim 1.

7. A method for breeding the TMS-resistant tobacco plant comprising a short N introgressed segment-according to claim 1, comprising:
   a) hybridizing a tobacco plant having a homozygous N introgressed segment with a tobacco plant having nn genotype to obtain a F1 tobacco plant having Nn genotype, and then hybridizing the F1 tobacco plant with tobacco plant having nn genotype to obtain a population material for screening the short N introgressed segment;
   b) inoculating TMV to the population material obtained in step a) during the seedling stage, and screening an $N_n$ genotype plan(exhibiting necrotic lesions in the population material; and
   c) genotyping the Nn genotype plant screened in step b) with a molecular marker of TN5.51 primer pair and N gene-specific, molecular marker N1N2 at the right end of the N introgressed segment, and screening for a plant detected as positive for the molecular marker N1N2 and negative for the TN5.51 primer pair,
   thereby obtaining a TMV-resistant tobacco plant comprising a short N introgressed segment according to claim 1.

8. A method for breeding the TMV-resistant tobacco plant comprising a short N introgressed segment according to claim 2, comprising:
   a) hybridizing a tobacco plant having homozygous N introgressed segment with a tobacco plant having nn genotype to obtain a F1 tobacco plant having Nn genotype, and then hybridizing the F1 tobacco plant with a tobacco plant having on genotype to obtain a population material for screening the short N introgressed segment;
   b) inoculating TMV to the population material obtained in step a) during the seedling stage, and screening an Nn genotype plant exhibiting lesions in the population material; and
   c) genotyping the Nn genotype plant screened in step b) with TN4.99 primer pair, TN5.20 primer pair, TN5.34 primer pair, TN5.51 primer pair and N gene-specific molecular marker N1N2, and screening for a plant detected as positive for molecular marker N1N2 and negative for TN4.99 primer pair, TN5.20 primer pair, TN5.34 primer pair and TN5.51 primer pair,
   thereby obtaining a TMV-resistant tobacco plant comprising a short N introgressed segment according to claim 2.

* * * * *

UNITED STATES PATENT AND TRADEMARK OFFICE
CERTIFICATE OF CORRECTION

| | | |
|---|---|---|
| PATENT NO. | : 11,259,473 B2 | Page 1 of 1 |
| APPLICATION NO. | : 16/648284 | |
| DATED | : March 1, 2022 | |
| INVENTOR(S) | : Yong Liu et al. | |

It is certified that error appears in the above-identified patent and that said Letters Patent is hereby corrected as shown below:

On the Title Page

(87) PCT Pub. No.: "WO2019/056206" should read --WO2019/056205--

Signed and Sealed this
Thirty-first Day of May, 2022

*Katherine Kelly Vidal*

Katherine Kelly Vidal
*Director of the United States Patent and Trademark Office*